US012529046B2

(12) United States Patent
Dong et al.

(10) Patent No.: US 12,529,046 B2
(45) Date of Patent: Jan. 20, 2026

(54) **PRODUCTION OF BOTULINUM NEUROTOXINS USING *BACILLUS* SYSTEMS**

(71) Applicant: Children's Medical Center Corporation, Boston, MA (US)

(72) Inventors: Min Dong, Weatogue, CT (US); Liang Tao, Boston, MA (US)

(73) Assignee: Children's Medical Center Corporation, Boston, MA (US)

( * ) Notice: Subject to any disclaimer, the term of this patent is extended or adjusted under 35 U.S.C. 154(b) by 0 days.

(21) Appl. No.: 16/965,650

(22) PCT Filed: Jan. 29, 2019

(86) PCT No.: PCT/US2019/015594
§ 371 (c)(1),
(2) Date: Jul. 29, 2020

(87) PCT Pub. No.: WO2019/152380
PCT Pub. Date: Aug. 8, 2019

(65) Prior Publication Data
US 2021/0040467 A1 Feb. 11, 2021

Related U.S. Application Data

(60) Provisional application No. 62/623,715, filed on Jan. 30, 2018.

(51) Int. Cl.
*C12N 9/52* (2006.01)
*C12N 15/75* (2006.01)

(52) U.S. Cl.
CPC ............... *C12N 9/52* (2013.01); *C12N 15/75* (2013.01); *C12Y 304/24069* (2013.01); *C07K 2319/20* (2013.01); *C07K 2319/55* (2013.01)

(58) Field of Classification Search
None
See application file for complete search history.

(56) References Cited

U.S. PATENT DOCUMENTS

| | | | | |
|---|---|---|---|---|
| 9,598,683 | B2 | 3/2017 | Chung et al. | |
| 10,190,110 | B2 | 1/2019 | Dong et al. | |
| 10,844,362 | B2 | 11/2020 | Dong et al. | |
| 11,104,891 | B2 | 8/2021 | Dong et al. | |
| 11,117,935 | B2 | 9/2021 | Dong et al. | |
| 11,268,080 | B2 | 3/2022 | Dong et al. | |
| 11,286,473 | B2 | 3/2022 | Dong et al. | |
| 2008/0057575 | A1* | 3/2008 | Fernandez-Salas | C07K 14/33 435/348 |
| 2009/0176259 | A1* | 7/2009 | Kalkum | G01N 33/573 435/7.94 |
| 2011/0306106 | A1 | 12/2011 | Sakurai et al. | |
| 2018/0163270 | A1* | 6/2018 | Mcdowell-Buchanan | B01L 7/52 |

FOREIGN PATENT DOCUMENTS

| | | | | | |
|---|---|---|---|---|---|
| CN | 1510145 | A | | 7/2004 | |
| CN | 101184770 | A | | 5/2008 | |
| CN | 102131823 | A | | 7/2011 | |
| CN | 105833254 | A | | 8/2016 | |
| CN | 105992817 | A | | 10/2016 | |
| CN | 104736166 | B | * | 2/2018 | A61K 38/00 |
| JP | 2008-508886 | A | | 3/2008 | |
| WO | WO 00/05252 | A1 | | 2/2000 | |
| WO | WO200005252 | | * | 2/2000 | C07K 14/33 |
| WO | WO 2006/011966 | A1 | | 2/2006 | |
| WO | WO 2006/017749 | A2 | | 2/2006 | |
| WO | WO 2017/214447 | A1 | | 12/2017 | |
| WO | WO 2018/009903 | A2 | | 1/2018 | |

OTHER PUBLICATIONS

Kiyatkin et al., nduction of an Immune Response by Oral Administration of Recombinant Botulinum Toxin. Infection and Immunity, vol. 65, No. 11, Nov. 1997, p. 4586-4591.*

PIR_80 database Acc# A35294 from Binz et al, The complete sequence of botulinum neurotoxin type A and comparison with other clostridial neurotoxins. J. Biol. Chem. 265, 9153-9158, 1990. Alignment with SID 127.*

SID1 from US-20080057575-A1 Fernandez-Salas; Ester G., 2008. Alignment with SID 127.*

Phuong et al, Production of XynX, a Large Multimodular Protein of Clostridium thermocellum, by Protease-Deficient *Bacillus* subtilis Strains. Appl Biochem Biotechnol (2012) 168:375-382.*

Wu et al, Engineering a *Bacillus* subtilis expression-secretion system with a strain deficient in six extracellular proteases. J Bacteriol . Aug. 1991;173(16):4952-8.*

Guan et al, Construction and development of an auto-regulatory gene expression system in *Bacillus* subtilis. Guan et al. Microb Cell Fact (2015) 14:150; 15pages.*

ThermoFisher Scientific, Inc from 'Protein Expression Systems'. Downloaded May 3, 2022.*

Phan et al, Development of Pgrac 100-based expression vectors allowing high protein production levels in *Bacillus* subtilis and relatively low basal expression in *Escherichia coli*. Phan et al. Microbial Cell Factories (2015) 14:72. 9pages.*

(Continued)

*Primary Examiner* — Hope A Robinson

(74) *Attorney, Agent, or Firm* — Wolf, Greenfield & Sacks, P.C.

(57) ABSTRACT

Described herein are *Bacillus* cells comprising a nucleotide sequence encoding a Botulinum neurotoxin (BoNT) and methods of producing the BoNT.

12 Claims, 5 Drawing Sheets

Specification includes a Sequence Listing.

(56) References Cited

OTHER PUBLICATIONS

Popp et al, The *Bacillus* BioBrick Box 2.0: expanding the genetic toolbox for the standardized work with *Bacillus* subtilis. Scientific Reports | 7: 15058 | 13 pages.*
Fahnestock et al., Protease-deficient *Bacillus* subtilis host strains for production of *Staphylococcal* protein A. Appl Environ Microbiol. Feb. 1987;53(2):379-84.
Hoang et al., Recombinant *Bacillus* subtilis expressing the Clostridium perfringens alpha toxoid is a candidate orally delivered vaccine against necrotic enteritis. Infect Immun. Nov. 2008;76(11):5257-65.
KR 10-2020-7024607, Jun. 18, 2024, Korean Office Action.
Neef et al., Recombinant protein secretion by *Bacillus* subtilis and Lactococcus lactis: pathways, applications, and innovation potential. Essays Biochem. Jul. 26, 2021;65(2):187-195. doi: 10.1042/EBC20200171.

* cited by examiner

PRODUCTION OF BOTULINUM NEUROTOXINS USING *BACILLUS* SYSTEMS

RELATED APPLICATION

This application is a National Stage Filing under 35 U.S.C. § 371 of International Application No. PCT/US2019/015594, filed Jan. 29, 2019, which claims the benefit under 35 U.S.C. § 119 (c) to U.S. Provisional Application No. 62/623,715, filed Jan. 30, 2018, and entitled "PRODUCTION OF BOTULINUM NEUROTOXINS USING BACILLUS SYSTEMS," the entire contents of each of which are incorporated herein by reference.

REFERENCE TO A SEQUENCE LISTING SUBMITTED AS A TEXT FILE VIA EFS-WEB

This application contains a Sequence Listing which has been submitted in ASCII format via EFS-Web and is hereby incorporated by reference in its entirety. Said ASCII copy, created on Mar. 8, 2023, is named C1233.70139US01-SUBSEQ-ARM and is 1,321,557 bytes in size.

BACKGROUND

Botulinum neurotoxins (BoNTs) are lethal toxins produced by *Clostridium botulinum*. These toxins can specifically target neuronal terminals of various vertebrates, block the neuron transmitter release, and cause flaccid paralysis usually called "botulism." The neuron blocking activity of the BoNTs can be utilized for therapeutic purpose, especially on neuron-related diseases, such as blepharospasm, strabismus, upper motor neuron syndrome, sweating, cervical dystonia, and chronic migraine. BoNTs are also widely used in the cosmetic industry.

SUMMARY

Some aspects of the present disclosure provide methods of producing Botulinum neurotoxins (BoNTs) recombinantly in *Bacillus*, the method comprising culturing a *Bacillus* cell comprising a nucleotide sequence encoding a BoNT, under conditions suitable for expressing the BoNT.

In some embodiments, the nucleotide sequence encoding the BoNT is operably linked to a promoter. In some embodiments, the promoter is an inducible promoter.

In some embodiments, the nucleotide sequence encoding the BoNT is in an expression vector. In some embodiments, the expression vector is selected from the group consisting of: pHT01, pHT08, pHT09, pHT10, pHT43, pHT253, pHT254, pHT 255, pNZ8901, pNZ8902, pNZ8910, pNZ8911, pWH1520, pMM1522, pMM1525, pHIS1522, pHIS1525, pSTREP1525, pSTREPHIS1525, pC-His1622, pC-Strep1622, pN-His-TEV1622, pN-Strep-TEV1622, pN-StrepXa1622, pSTOP1622, p3STOP1623 hp, pC-HIS1623 hp, pN-His-TEV1623 hp, pSP-LipA-hp, pSP-YocH-hp, p3STOP1623-2RBShp, pC-STREP1623 hp, pN-STREP-Xa1623 hp, pN-STREP_TEV1623 hp, pMGBm19, pPT7, pPT7-SPlipA, pPconst1326, pBP26, pBP27, pBQ200, pGP380, pGP382, pGP886, pGP888, pGP1459, pGP1460, pGP1389, pBE-S, and pRB374.

In some embodiments, the BoNT is fused to a fusion domain at the N- or C-terminus. In some embodiments, the fusion domain is an affinity tag. In some embodiments, the affinity tag is selected from the group consisting of: His6, GST, Avi, Strep, S, MBP, Sumo, FLAG, HA, Myc, SBP, E, Calmodulin, Softag 1, Softag 3, TC. V5, VSV, Xpress, Halo, and Fc.

In some embodiments, the nucleotide sequence encoding the BoNT is codon optimized for expression in *Bacillus*.

In some embodiments, the BoNT is selected from the group consisting of: BoNT/A, BONT/B, BONT/C, BONT/D, BONT/E, BONT/F, BONT/G, BONT/X, BoNT/En, and variants thereof. In some embodiments, the BoNT is a catalytically inactive BoNT. In some embodiments, the BoNT is a full-length BoNT. In some embodiments, the BoNT is a chimeric BoNT. In some embodiments, the BoNT comprises an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or at least 99.5% identical to any one of SEQ ID NOs: 1-139. In some embodiments, the BONT comprises the amino acid sequence of any one of SEQ ID NOs: 1-139.

In some embodiments, the method further comprises delivering the nucleotide sequence encoding the BoNT into the *Bacillus* cell. In some embodiments, the nucleotide sequence encoding the BoNT is delivered via transformation, transduction, conjugation, and electroporation.

In some embodiments, the method further comprises purifying the BoNT from the *Bacillus* cell. In some embodiments, the BoNT is purified via affinity chromatography, ion exchange chromatography, size-exclusion chromatography, or combinations thereof.

In some embodiments, the *Bacillus* cell is selected from the group consisting of: *Bacillus subtilis, Bacillus megaterium, Bacillus anthracis*, and *Bacillus brevis*. In some embodiments, the *Bacillus* cell is a wild type cell. In some embodiments, the *Bacillus* cell is an engineered cell. In some embodiments, the *Bacillus* is a protease deficient *Bacillus* cell.

Other aspects of the present disclosure provide a *Bacillus* cell comprising a nucleotide sequence encoding a Botulinum neurotoxin (BoNT). In some embodiments, the nucleotide sequence encoding the BoNT is operably linked to a promoter. In some embodiments, the promoter is an inducible promoter.

In some embodiments, the nucleotide sequence encoding the BoNT is in an expression vector. In some embodiments, the expression vector is selected from the group consisting of: pHT01, pHT08, pHT09, pHT10, pHT43, pHT253, pHT254, pHT 255, pNZ8901, pNZ8902, pNZ8910, pNZ8911, pWH1520, pMM1522, pMM1525, pHIS1522, pHIS1525, pSTREP1525, pSTREPHIS1525, pC-His1622, pC-Strep1622, pN-His-TEV1622, pN-Strep-TEV1622, pN-StrepXa1622, pSTOP1622, p3STOP1623 hp, pC-HIS1623 hp, pN-His-TEV1623 hp, pSP-LipA-hp, pSP-YocH-hp, p3STOP1623-2RBShp, pC-STREP1623 hp, pN-STREP-Xa1623 hp, pN-STREP_TEV1623 hp, pMGBm19, pPT7, pPT7-SPlipA, pPconst1326, pBP26, pBP27, pBQ200, pGP380, pGP382, pGP886, pGP888, pGP1459, pGP1460, pGP1389, pBE-S, and pRB374.

In some embodiments, the BoNT is fused to a fusion domain at the N- or C-terminus. In some embodiments, the fusion domain is an affinity tag. In some embodiments, the affinity tag is selected from the group consisting of: His6, GST, Avi, Strep, S, MBP, Sumo, FLAG, HA, Myc, SBP, E, Calmodulin, Softag 1, Softag 3, TC, V5, VSV, Xpress, Halo, and Fc.

In some embodiments, the nucleotide sequence encoding the BoNT is codon optimized for expression in *Bacillus*. In some embodiments, the BoNT is selected from the group consisting of: BONT/A, BONT/B, BONT/C, BONT/D, BONT/E, BONT/F, BONT/G, BONT/X, BoNT/En, and variants thereof. In some embodiments, the BoNT is a catalytically inactive BONT. In some embodiments, the BoNT is a full-length BoNT. In some embodiments, the BONT is a chimeric BoNT. In some embodiments, the BoNT comprises an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or at least 99.5% identical to any one of SEQ ID NOs: 1-139. In some embodiments, the BoNT comprises the amino acid sequence of any one of SEQ ID NOs: 1-139.

In some embodiments, the *Bacillus* cell is selected from the group consisting of: *Bacillus subtilis, Bacillus megaterium*, and *Bacillus anthracis*, and *Bacillus brevis*. In some embodiments, the *Bacillus* cell is a wild type cell. In some embodiments, the *Bacillus* cell is an engineered cell. In some embodiments, the *Bacillus* is a protease deficient *Bacillus* cell.

BRIEF DESCRIPTION OF THE DRAWINGS

The accompanying drawings are not intended to be drawn to scale. In the drawings, each identical or nearly identical component that is illustrated in various figures is represented by a like numeral. For purposes of clarity, not every component may be labeled in every drawing. In the drawings:

FIG. 2A. Surface charge analysis of BoNT/A (left) and BoNT/B (right). FIG. 2B. Surface hydrophobicity analysis of BoNT/A (left) and BoNT/B (right).

FIG. 4A. Western-blots of expression pattern of iBoNT/B in *B. subtilis*. FIG. 4B. Purification of iBoNT/B from *B. subtilis*. Both SDS-PAGE and WB are shown. An anti-BoNT/B polyclonal antibody was used for WB.

DETAILED DESCRIPTION OF CERTAIN EMBODIMENTS

Figure 1:
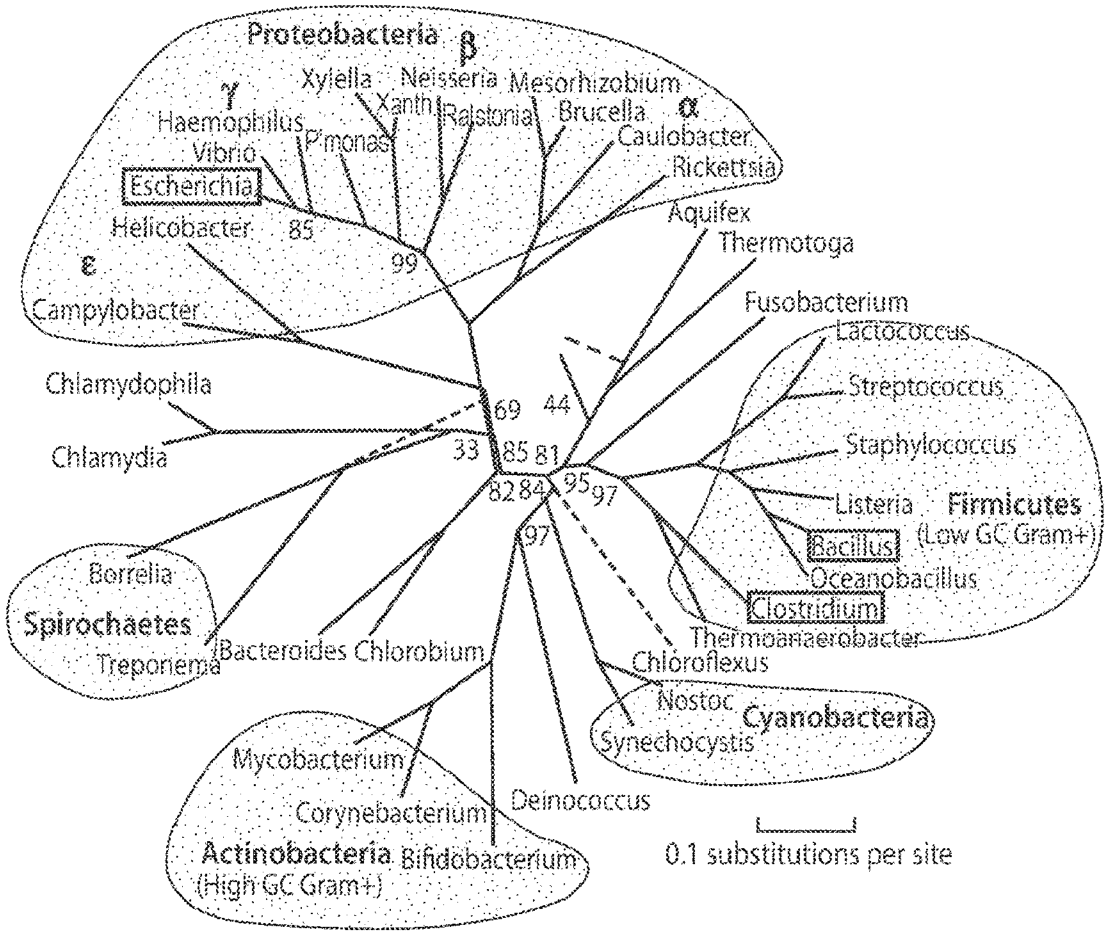
FIG. 1. A rooted phylogenetic tree of Bacterial kingdom. *Escherichia, Bacillus*, and *Clostridium* genera are highlighted by boxes. *Bacillus* and *Clostridium* belong to the Firmicute phylum.

Botulinum neurotoxins (BoNTs) are lethal toxins produced by *Clostridium botulinum*. These toxins can specifically target neuronal terminals of various vertebrates, block the neuron transmitter release, and cause flaccid paralysis usually called "botulism". On the other hand, this property of the toxins can be utilized for therapeutic purpose, especially for neuron-related diseases. Starting from the 1960s, the efficacy of BoNTs in treating neuronal diseases has been explored and BoNTs are now widely used to treat a number of neuronal diseases including, without limitation, blepharospasm, strabismus, upper motor neuron syndrome, sweating, cervical dystonia, and chronic migraine. BoNTs are also widely used in the cosmetic industry. In December 1989, BOTOX, the first BONT product, was proved by US Food and Drug Administration (FDA) for clinical treatment.

All commercial BoNT products for medical and cosmetic purpose are purified from their natural host *C. botulinum*. The procedure is time consuming and costly. Moreover, genetic operation is extremely difficult in *C. botulinum*, which is always an obstacle for developing engineered full length BoNTs. *Escherichia coli* cells are most commonly used bacterial hosts for expressing engineered proteins. After testing expression and production of BoNTs in *E. coli*, it was found that *E. coli* lack the ability to well express large proteins like BoNTs, especially for certain subtypes and engineered/chimeric toxins, which could be a hindrance for large-scale industrial production.

Provided herein are *Bacillus* cells comprising a nucleotide sequence encoding a Botulinum neurotoxin (BoNT) and methods of producing the BoNT by culturing said *Bacillus* cell under conditions suitable for expressing the BoNT.

"Botulinum neurotoxins (BoNTs)," as described herein, refer to a family of bacterial toxins that act by blocking neurotransmitter release from neurons, thus causing paralysis. As described herein, the term "BoNT" encompasses neurotoxins produced by *Clostridium Botulinum* and by other bacterial species but structurally and functionally belong to the BoNT family, and any fragments or variants thereof. BoNTs produced by *Clostridium Botulinum* include eight major serotypes: BoNT/A-G (e.g., as described in Schiavo et al., Physiol Rev 80, 717-766 (2000), incorporated herein by reference), and BoNT/X (e.g., as described in Zhang et al., Nature Communications, 8, Article number: 14130 (2017), incorporated herein by reference). Each BoNT serotype may have subtypes. For example, BoNT/A has 8 subtypes, BONT/A1, BONT/A2, BONT/A3, BONT/A4, BONT/A5, BONT/A6, BONT/A7, and BONT/A8.

Similarly, BoNT/B also has 8 subtypes, BoNT/B1, BoNT/B2, BoNT/B3, BONT/B4, BoNT/B5, BONT/B6, BoNT/B7, and BoNT/B8. It has been found that bacterial species other than *Clostridium Botulinum* also produce neurotoxins that belong to the BoNT family, i.e., have similar structure or function as a BoNT produced by *Clostridium Botulinum*. For example, a BONT family neurotoxin was identified in *Enterococcus faecium* and was designated "BoNT/En" (e.g., as described in Zhang et al., 2018, Cell Host and Microbe, 23:1-8, Doi: 10.1016/j.chom.2017.12.018, incorporated herein by reference).

In some embodiments, the BoNT is a full-length BONT. A "full-length" BONT refers to a BoNT that does not have any truncations, compared to a wild-type BoNT. A full-length BONT may contain other types of mutations, compared to a wild-type BoNT, e.g., amino acid substitutions or fusion domains. In some embodiments, the BoNT is a naturally occurring, wild-type BoNT, e.g., any of the BoNTs described herein and known in the art. In some embodiments, the BoNT is a variant of a wild-type BoNT. BONT variants have been previously described. For example, BoNT variants that have enhanced binding to target cells are described in PCT Application Publication WO 2017214447, incorporated herein by reference. In another example, the BoNT is a catalytically inactive variant, e.g., as described in PCT Application Publication WO 2018009903, incorporated herein by reference.

A BoNT comprises a heavy chain (herein termed "BoNT-HC") and a light chain (herein termed "BoNT-LC") linked by a linker region. A proteolytic cleavage occurs in the linker region when a BoNT is processed into its mature form. The BoNT-LC comprises a protease domain that cleaves the substrates of the BoNT, while the BoNT-HC comprises a translocation domain at the N terminus of the heavy chain (HN) and a receptor binding domain at the C terminus of the heavy chain (Hc), which mediate the entering of the BoNT into a cell. It has been shown that chimeric BoNTs can exert the function of a naturally occurring BONT. A "chimeric BONT" refers to a BoNT comprising domains from different BONT serotypes. In some embodiments, a chimeric BoNT may contain the protease domain (LC) and the translocation domain (HN) from one BoNT (e.g., any one of BoNT/A-G, BoNT/X, and BoNT/En) and the receptor binding domain (Hc) from a different BoNT (e.g., from any one of BONT/A-G, BoNT/X, and BoNT/En, except where the LC and Hy are from). In some embodiments, a chimeric BoNT comprises other variations, e.g., amino acid substations. Non-limiting, exemplary chimeric BoNTs are provided in Table 1.

In some embodiments, the BoNT produced using the method described herein comprises an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or at least 99.5% identical to any one of SEQ ID NOs: 1-139. In some embodiments, the BoNT produced using the method described herein comprises the amino acid sequence of any one of SEQ ID NOs: 1-139. In some embodiments, the BoNT produced using the method described herein consists of the amino acid sequence of any one of SEQ ID NOs: 1-139. Non-limiting, exemplary amino acid sequences of the BoNTs that can be produced using the methods described herein are provided in Table 1.

In some embodiments, the BoNT is fused to a fusion domain at the N- or C-terminus. A "fusion domain" refers to a polypeptide sequence that is appended to the BoNT via an amide bond. In some embodiments, the fusion domain is an affinity tag. An "affinity tag," as used herein, refers to a polypeptide sequence that can bind specifically to a substance or a moiety, e.g., a tag comprising six Histidines bind specifically to $Ni^{2+}$. Affinity tags may be appended to proteins to facilitate their isolation. The affinity tags are typically fused to proteins via recombinant DNA techniques known by those skilled in the art. The use of affinity tags to facilitate protein isolate is also well known in the art. Suitable affinity tags that may be used in accordance with the present disclosure include, without limitation, His6, GST, Avi, Strep, S, MBP, Sumo, FLAG, HA, Myc, SBP, E, Calmodulin, Softag 1, Softag 3, TC, V5, VSV, Xpress, Halo, and Fc.

Other aspects of the present disclosure provide nucleotide sequences encoding the BoNTs described herein. A "nucleotide sequence" is at least two nucleotides covalently linked together, and in some instances, may contain phosphodiester bonds (e.g., a phosphodiester "backbone"). A nucleotide sequence may be DNA, both genomic and/or cDNA, RNA or a hybrid, where the nucleotide sequence contains any combination of deoxyribonucleotides and ribonucleotides (e.g., artificial or natural), and any combination of bases, including uracil, adenine, thymine, cytosine, guanine, inosine, xanthine, hypoxanthine, isocytosine and isoguanine.

In some embodiments, the nucleotide sequence encoding the BoNT is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or at least 99.5%, or 100% identical to any one of SEQ ID NOs: 1-139. In some embodiments, the nucleotide sequence encoding the BoNT is 85%, 86%, 87%, 88%, 89%, 90%, 91%, 92%, 93%, 94%, 95%, 96%, 97%, 98%, 99%, or 100% identical to any one of SEQ ID NOs: 1-139.

In some embodiments, the nucleotide sequence encoding the BoNT is codon optimized for expression in a *Bacillus* cell. Codon optimization methods are known in the art and may be used as provided herein. Codon optimization, in some embodiments, may be used to match codon frequencies in target and host organisms to ensure proper folding; bias GC content to increase mRNA stability or reduce secondary structures; minimize tandem repeat codons or base runs that may impair gene construction or expression; customize transcriptional and translational control regions; insert or remove protein trafficking sequences; remove/add post translation modification sites in encoded protein (e.g. glycosylation sites); add, remove or shuffle protein domains; insert or delete restriction sites; modify ribosome binding sites and mRNA degradation sites; adjust translational rates to allow the various domains of the protein to fold properly; or to reduce or eliminate problem secondary structures within the polynucleotide. Codon optimization tools, algorithms and services are known in the art—non-limiting examples include services from GeneArt (Life Technologies), DNA2.0 (Menlo Park CA) and/or proprietary methods. In some embodiments, the open reading frame (ORF) sequence is optimized using optimization algorithms.

In some embodiments, a codon optimized sequence shares less than 95%, less than 90%, less than 85%, less than 80%, less than 75%, less than 70%, less than 65%, or less than 60% sequence identity to a naturally-occurring or wild-type sequence (e.g., a naturally-occurring or wild-type mRNA sequence encoding a BoNT). In some embodiments, a codon optimized sequence shares 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to a naturally-occurring or wild-type sequence (e.g., a naturally-occurring or wild-type mRNA sequence encoding a BoNT).

In some embodiments, the nucleotide sequence encoding the BoNT is operably linked to a promoter. A "promoter" refers to a control region of a nucleotide sequence at which initiation and rate of transcription of the remainder of a nucleotide sequence are controlled. A promoter drives expression or drives transcription of the nucleotide sequence that it regulates. A promoter may also contain sub-regions at which regulatory proteins and molecules may bind, such as RNA polymerase and other transcription factors. Promoters may be constitutive, inducible, activatable, repressible, tissue-specific or any combination thereof. A promoter is considered to be "operably linked" when it is in a correct functional location and orientation in relation to a nucleotide sequence it regulates to control ("drive") transcriptional initiation and/or expression of that sequence.

A promoter may be one naturally associated with a gene or sequence, as may be obtained by isolating the 5' non-coding sequences located upstream of the coding segment of a given gene or sequence. Such a promoter can be referred to as "endogenous."

In some embodiments, a coding nucleotide sequence may be positioned under the control of a recombinant or heterologous promoter, which refers to a promoter that is not normally associated with the encoded sequence in its natural environment. Such promoters may include promoters of other genes; promoters isolated from any other cell; and synthetic promoters or enhancers that are not "naturally occurring" such as, for example, those that contain different elements of different transcriptional regulatory regions and/or mutations that alter expression through methods of genetic engineering that are known in the art. In addition to producing nucleic acid sequences of promoters and enhancers synthetically, sequences may be produced using recombinant cloning and/or nucleic acid amplification technology, including polymerase chain reaction (PCR) (see U.S. Pat. Nos. 4,683,202 and 5,928,906).

In some embodiments, a promoter is an "inducible promoter," which refers to a promoter that is characterized by regulating (e.g., initiating or activating) transcriptional activity when in the presence of, influenced by or contacted by an inducer signal. An inducer signal may be endogenous or a normally exogenous condition (e.g., light), compound (e.g., chemical or non-chemical compound) or protein that contacts an inducible promoter in such a way as to be active in regulating transcriptional activity from the inducible promoter. Thus, a "signal that regulates transcription" of a nucleic acid refers to an inducer signal that acts on an inducible promoter. A signal that regulates transcription may activate or inactivate transcription, depending on the regulatory system used. Activation of transcription may involve directly acting on a promoter to drive transcription or indirectly acting on a promoter by inactivation a repressor that is preventing the promoter from driving transcription. Conversely, deactivation of transcription may involve directly acting on a promoter to prevent transcription or indirectly acting on a promoter by activating a repressor that then acts on the promoter. In some embodiments, using inducible promoters in the genetic circuits of the cell state classifier results in the conditional expression or a "delayed" expression of a gene product.

The administration or removal of an inducer signal results in a switch between activation and inactivation of the transcription of the operably linked nucleotide sequence. Thus, the active state of a promoter operably linked to a nucleotide sequence refers to the state when the promoter is actively regulating transcription of the nucleotide sequence (i.e., the linked nucleotide sequence is expressed). Conversely, the inactive state of a promoter operably linked to a nucleotide sequence refers to the state when the promoter is not actively regulating transcription of the nucleotide sequence (i.e., the linked nucleotide sequence is not expressed).

An inducible promoter of the present disclosure may be induced by (or repressed by) one or more physiological condition(s), such as changes in light, pH, temperature, radiation, osmotic pressure, saline gradients, cell surface binding, and the concentration of one or more extrinsic or intrinsic inducing agent(s). An extrinsic inducer signal or inducing agent may comprise, without limitation, amino acids and amino acid analogs, saccharides and polysaccharides, nucleic acids, protein transcriptional activators and repressors, cytokines, toxins, petroleum-based compounds, metal containing compounds, salts, ions, enzyme substrate analogs, hormones or combinations thereof.

Inducible promoters of the present disclosure include any inducible promoter described herein or known to one of ordinary skill in the art. Examples of inducible promoters include, without limitation, chemically/biochemically-regulated and physically-regulated promoters such as alcohol-regulated promoters, tetracycline-regulated promoters (e.g., anhydrotetracycline (aTc)-responsive promoters and other tetracycline-responsive promoter systems, which include a tetracycline repressor protein (tetR), a tetracycline operator sequence (tetO) and a tetracycline transactivator fusion protein (ITA)), steroid-regulated promoters (e.g., promoters based on the rat glucocorticoid receptor, human estrogen receptor, moth ecdysone receptors, and promoters from the steroid/retinoid/thyroid receptor superfamily), metal-regulated promoters (e.g., promoters derived from metallothionein (proteins that bind and sequester metal ions) genes from yeast, mouse and human), pathogenesis-regulated promoters (e.g., induced by salicylic acid, ethylene or benzothiadiazole (BTH)), temperature/heat-inducible promoters (e.g., heat shock promoters), and light-regulated promoters (e.g., light responsive promoters from plant cells).

In some embodiments, an inducer signal of the present disclosure is an N-acyl homoserine lactone (AHL), which is a class of signaling molecules involved in bacterial quorum sensing. Quorum sensing is a method of communication between bacteria that enables the coordination of group based behavior based on population density. AHL can diffuse across cell membranes and is stable in growth media over a range of pH values. AHL can bind to transcriptional activators such as LuxR and stimulate transcription from cognate promoters.

In some embodiments, an inducer signal of the present disclosure is anhydrotetracycline (aTc), which is a derivative of tetracycline that exhibits no antibiotic activity and is designed for use with tetracycline-controlled gene expression systems, for example, in bacteria.

In some embodiments, an inducer signal of the present disclosure is isopropyl β-D-1-thiogalactopyranoside (IPTG), which is a molecular mimic of allolactose, a lactose metabolite that triggers transcription of the lac operon, and it is therefore used to induce protein expression where the gene is under the control of the lac operator. IPTG binds to the lac repressor and releases the tetrameric repressor from the lac operator in an allosteric manner, thereby allowing the transcription of genes in the lac operon, such as the gene coding for beta-galactosidase, a hydrolase enzyme that catalyzes the hydrolysis of β-galactosides into monosaccharides. The sulfur(S) atom creates a chemical bond which is non-hydrolyzable by the cell, preventing the cell from metabolizing or degrading the inducer. IPTG is an effective inducer of protein expression, for example, in the concentration range of 100 μM to 1.0 mM. Concentration used depends on the strength of induction required, as well as the genotype of cells or plasmid used. If lacIq, a mutant that over-produces the lac repressor, is present, then a higher concentration of IPTG may be necessary. In blue-white screen, IPTG is used together with X-gal. Blue-white screen allows colonies that have been transformed with the recombinant plasmid rather than a non-recombinant one to be identified in cloning experiments.

Other inducible promoter systems are known in the art and may be used in accordance with the present disclosure.

In some embodiments, inducible promoters of the present disclosure are from prokaryotic cells (e.g., bacterial cells). Examples of inducible promoters for use prokaryotic cells include, without limitation, bacteriophage promoters (e.g. Pls1con, T3, T7, SP6, PL) and bacterial promoters (e.g., Pbad, PmgrB, Ptrc2, Plac/ara, Ptac, Pm), or hybrids thereof (e.g. PLlacO, PLtetO). Examples of bacterial promoters for use in accordance with the present disclosure include, without limitation, positively regulated *E. coli* promoters such as positively regulated 670 promoters (e.g., inducible pBad/araC promoter, Lux cassette right promoter, modified lamdba Prm promote, plac Or2-62 (positive), pBad/AraC with extra REN sites, pBad, P (Las) TetO, P (Las) CIO, P (Rhl), Pu, FecA, pRE, cadC, hns, pLas, pLux), oS promoters (e.g., Pdps), σ32 promoters (e.g., heat shock) and 654 promoters (e.g., glnAp2); negatively regulated *E. coli* promoters such as negatively regulated σ70 promoters (e.g., Promoter (PRM+), modified lamdba Prm promoter, TetR-TetR-4C P (Las) TetO, P (Las) CIO, P (Lac) IQ. RecA_DlexO_DLacO1, dapAp, FecA, Pspac-hy, pcI, plux-cI, plux-lac, CinR, CinL, glucose controlled, modified Pr, modified Prm+, FecA, Pcya, rec A (SOS), Rec A (SOS), EmrR- _regulated, BetI_regulated, pLac_lux, pTet_Lac, pLac/Mnt, pTet/Mnt, LsrA/cI, pLux/cI, LacI, LacIQ, pLacIQ1, pLas/cI, pLas/Lux, pLux/Las, pRecA with LexA binding site, reverse BBa_R0011, pLacI/ara-1, pLacIq, rrnB P1, cadC, hns, PfhuA, pBad/araC, nhaA, OmpF, RcnR), σS promoters (e.g., Lutz-Bujard LacO with alternative sigma factor σ38), σ32 promoters (e.g., Lutz-Bujard LacO with alternative sigma factor σ32), and σ54 promoters (e.g., glnAp2); negatively regulated *B. subtilis* promoters such as repressible *B. subtilis* σA promoters (e.g., Gram-positive IPTG-inducible, Xyl, hyper-spank) and σB promoters. Other inducible microbial promoters may be used in accordance with the present disclosure.

The efficiency of expression may be enhanced by the inclusion of appropriate transcription enhancer elements, transcription terminators, etc. In addition, a host cell strain (e.g., *Bacillus*) may be chosen which modulates the expression of the inserted sequences, or modifies and processes the gene product in the specific fashion desired. Such modifications (e.g., glycosylation) and processing (e.g., cleavage) of protein products may be important for the function of the protein. For example, the BoNT described herein is expressed as a single gene product (e.g., as a single polypeptide chain), and is then proteolytic cleavage in the linker region to be processed into its mature form.

In some embodiments, the nucleotide sequence encoding the BoNT is incorporated into vectors (e.g., cloning vectors or expression vectors). A "vector" refers to a nucleic acid (e.g., DNA) used as a vehicle to artificially carry genetic material (e.g., an engineered nucleic acid) into a cell where, for example, it can be replicated and/or expressed. In some embodiments, a vector is an episomal vector (see, e.g., Van Craenenbroeck K. et al. Eur. J. Biochem. 267, 5665, 2000, incorporated by reference herein). A non-limiting example of a vector is a plasmid. Plasmids are double-stranded generally circular DNA sequences that are capable of automatically replicating in a host cell. Plasmid vectors typically contain an origin of replication that allows for semi-independent replication of the plasmid in the host and also the transgene insert. Plasmids may have more features, including, for example, a "multiple cloning site," which includes nucleotide overhangs for insertion of a nucleic acid insert, and multiple restriction enzyme consensus sites to either side of the insert. Another non-limiting example of a vector is a viral vector (e.g., retroviral, adenoviral, adeno-association, helper-dependent adenoviral systems, hybrid adenoviral systems, herpes simplex, pox virus, lentivirus, Epstein-Barr virus). In some embodiments, the viral vector is derived from an adeno-associated virus (AAV). In some embodiments, the viral vector is derived from an herpes simplex virus (HSV).

Additionally, the vector may contain, for example, some or all of the following: a selectable marker gene, e.g., genes that confer antibiotic resistance to the *Bacillus* cell. Suitable vectors and methods for producing vectors containing transgenes are well known and available in the art.

In bacterial systems, a number of expression vectors may be advantageously selected depending upon the use intended for the polypeptides being expressed. For example, when a large quantity of such a protein is to be produced, for the generation of pharmaceutical compositions of polypeptides described herein, vectors which direct the expression of high levels of fusion protein products that are readily purified may be desirable. Such vectors include, but are not limited, to the *E. coli* expression vector pUR278 (Rüther et al. (1983) "Easy Identification Of cDNA Clones," EMBO J. 2:1791-1794), in which the coding sequence may be ligated individually into the vector in frame with the lac Z coding region so that a fusion protein is produced; pIN vectors (Inouye et al. (1985) "Up-Promoter Mutations In The lpp Gene Of *Escherichia Coli*," Nucleic Acids Res. 13:3101-3110; Van Hecke et al. (1989) "Expression Of Human Asparagine Synthetase In *Escherichia Coli*," J. Biol. Chem. 24:5503-5509); and the like. pGEX vectors may also be used to express foreign polypeptides as fusion proteins with glutathione S-transferase (GST). In general, such fusion proteins are soluble and can easily be purified from lysed cells by adsorption and binding to a matrix glutathione-agarose beads followed by elution in the presence of free glutathione.

The pGEX vectors are designed to include thrombin or factor Xa protease cleavage sites so that the cloned target gene product can be released from the GST moiety. In an insect system, *Autographa californica* nuclear polyhedrosis virus (AcNPV) is used as a vector to express foreign genes. The virus grows in *Spodoptera frugiperda* cells. The coding sequence may be cloned individually into non-essential regions (e.g., the polyhedrin gene) of the virus and placed under control of an AcNPV promoter (e.g., the polyhedrin promoter).

In some embodiments, the vectors are adapted for expressing the BoNT in a *Bacillus* cell. Expression vectors suitable for expressing proteins (e.g., BoNT) in a *Bacillus* cell are commercially available. For example, Mibitec GmbH (Germany) provides numberous expression vectors suitable for protein expression in *Bacillus*, including, pHT01 (#PBS001), pHT08 (#PBS003), pHT09 (#PBS004), pHT10 (#PBS005), pHT43 (#PBS002), pHT253 (#PBS013), pHT254 (#PBS014), pHT255 (#PBS015), pNZ8901 (#PBS031), pNZ8902 (#PBS032), pNZ8910 (#PBS033), pNZ8911 (#PBS034), pWH1520 (#BMEG03), pMM1522 (#BMEG10), pMM1525 (#BMEG 11), pHIS1522 (#BMEG 12), pHIS1525 (#BMEG 13), pSTREP1525 (#BMEG 14), pSTREPHIS1525 (#BMEG 15), pC-His1622 (#BMEG 20), pC-Strep1622 (#BMEG 21), pN-His-TEV1622 (#BMEG 22), pN-Strep-TEV1622 (#BMEG 23), pN-StrepXa1622 (#BMEG 24), pSTOP1622 (#BMEG 25), p3STOP1623 hp (#BMEG 30), pC-HIS1623 hp (#BMEG31), pN-His-TEV1623 hp (#BMEG 32), pSP-LipA-hp (#BMEG 33), pSP-YocH-hp (#BMEG 34), p3STOP1623-2RBShp (#BMEG 35), pC-STREP1623 hp (#BMEG 36), pN-STREP-Xa1623 hp (#BMEG 37), pN-STREP_TEV1623 hp (#BMEG 38), pMGBm19 (#BMEG 39), pPT7 (#BMEG T710), pPT7-SPlipA (#BMEG T711), and pPconst1326 (#BMEG 45). Takara Bio Inc. (Japan) provides a *Bacillus subtilis* secretory protein expression system (#3380) including an expression vector pBES. Further, ATCC provides vector pRB374 (#ATCC77374) for *Bacillus* expression. One skilled in the art is able to choose the appropriate expression vector.

The method of producing a BoNT described herein comprises culturing a *Bacillus* cell comprising the nucleotide sequence encoding the BoNT under conditions suitable for expressing the BoNT. In some embodiments, the method further comprises delivering the nucleotide sequence encoding the BoNT to a *Bacillus* cell. Standard molecular biology techniques are used to prepare and deliver the recombinant expression vector, and culture the *Bacillus* cells. An expression vector comprising the nucleotide sequence encoding the BoNT can be transferred to a host cell by conventional techniques (e.g., electroporation, transformation, transduction, or conjugation) and the resulting *Bacillus* cells are then cultured by conventional techniques to produce the BoNT described herein.

The *Bacillus* cells may be cultured at an appropriate temperature (e.g., 16° C.-42° C.) for an appropriate amount of time (e.g., 4-72 hours). In some embodiments, the *Bacillus* cells are cultured at 16, 18, 20, 25, 30, 35, 37, 40, or 42° C. In some embodiments, the *Bacillus* cells are cultured for 4, 5, 6, 7, 8, 9, 10, 11, 12, 13, 14, 15, 16, 17, 18, 19, 20, 21, 22, 23, 24, 36, 48, 60, 72 hours or longer. Any standard culturing media (e.g., Luria-Bertani (LB) media) suitable for *Bacillus* cells can be used. If the expression of the BoNT is driven by an inducible promoter, the media may further contain an inducer at an appropriate concentration that activates the inducible promoter.

Once the BoNT has been recombinantly expressed, it may be purified by any method known in the art for example, by chromatography (e.g., affinity chromatography, ion exchange chromatography, size-exclusion chromatography, or combinations thereof), centrifugation, differential solubility, or by any other standard technique for the purification of polypeptides.

The BoNT produced using the method described herein is substantially free of (e.g., at least 80%, 90%, 95%, 97%, 99%, or 99.5% free of), other protein(s) and/or other polypeptide(s) (e.g., other *Bacillus* proteins). In some embodiments, the isolated polypeptides is 100% free of other protein(s) and/or other polypeptide(s) (e.g., *Bacillus* proteins). The methods described herein provide high yield of intact BoNTs. Being "intact" means that the BONT products are substantially free of truncated products (e.g., those produced due to aborted translation or protease cleavage). As demonstrated herein, in some embodiments, about 5-10 mg protein can be obtained from one litter LB cultured *B. subtilis*.

The BoNT produced using the methods herein have comparable biological activities as a naturally occurring BoNT (e.g., in target cell recognition, translocation, and/or substrate cleavage). Having "comparable biological activity" means that the BoNT produced using the methods described herein are have at least 50%, at least 60%, at least 70%, at least 80%, at least 90%, at least 95%, or at least 99% of the biological activity (e.g., in target cell recognition, translocation, and substrate cleavage) of a naturally occurring BoNT. In some embodiments, the BoNT produced using the methods described herein are have 50%, 55%, 60%, 65%, 70%, 75%, 80%, 85%, 90%, 95%, 99% or more of the biological activity (e.g., in target cell recognition, translocation, and substrate cleavage) of a naturally occurring BoNT.

The host cells used for BONT expression in the methods described herein are *Bacillus* cells. Exemplary *Bacillus* cells that may be used include, without limitation: *B. acidiceler, B. acidicola, B. acidiproducens, B. acidocaldarius, B. acidoterrestris, B. aeolius, B. aerius, B. aerophilus, B. agaradhaerens, B. agri, B. aidingensis, B. akibai, B. alcalophilus, B. algicola, B. alginolyticus, B. alkalidiazotrophicus, B. alkalinitrilicus, B. alkalisediminis, B. alkalitelluris, B. altitudinis, B. alveayuensis, B. alvei, B. amyloliquefaciens, B. aminovorans* [2], *B. amylolyticus, B. andreesenii, B. aneurinilyticus, B. anthracis, B. aquimaris, B. arenosi, B. arseniciselenatis, B. arsenicus, B. aurantiacus, B. arvi, B. aryabhattai, B. asahii, B. atrophaeus, B. axarquiensis, B. azotofixans, B. azotoformans, B. badius, B. barbaricus, B. bataviensis, B. beijingensis, B. benzoevorans, B. beringensis, B. berkeleyi, B. beveridgei, B. bogoriensis, B. boroniphilus, B. borstelensis, B. brevis Migula, B. butanolivorans, B. canaveralius, B. carboniphilus, B. cecembensis, B. cellulosilyticus, B. centrosporus, B. cereus, B. chagannorensis, B. chitinolyticus, B. chondroitinus, B. choshinensis, B. chungangensis, B. cibi, B. circulans, B. clarkii, B. clausii, B. coagulans, B. coahuilensis, B. cohnii, B. composti, B. curdlanolyticus, B. cycloheptanicus, B. cytotoxicus, B. daliensis, B. decisifrondis, B. decolorationis, B. deserti, B. dipsosauri, B. drentensis, B. edaphicus, B. ehimensis, B. eiseniae, B. enclensis, B. endophyticus, B. endoradicis, B. farraginis, B. fastidiosus, B. fengqiuensis, B. firmus, B. flexus, B. foraminis, B. fordii, B. formosus, B. fortis, B. fumarioli, B. funiculus, B. fusiformis, B. galactophilus, B. galactosidilyticus, B. galliciensis, B. gelatini, B. gibsonii, B. ginsengi, B. ginsengihumi, B. ginsengisoli, B. glucanolyticus, B. gordonae, B. gottheilii, B. graminis, B. halmapalus, B. haloalkaliphilus, B. halochares, B. halodenitrificans, B. halodurans, B. halophilus, B. halosaccharovorans, B. hemicellulosilyticus, B. hemicentroti, B. herbersteinensis, B. horikoshii, B. horneckiae, B. horti, B. huizhouensis, B. humi, B. hwajinpoensis, B. idriensis, B. indicus, B. infantis, B. infernus, B. insolitus, B. invictae, B. iranensis, B. isabeliae, B. isronensis, B. jeotgali, B. kaustophilus, B. kobensis, B. kochii, B. kokeshiiformis, B. koreensis, B. korlensis, B. kribbensis, B. krulwichiae, B. laevolacticus, B. larvae, B. laterosporus, B. lautus, B. lehensis, B. lentimorbus, B. lentus, B. licheniformis, B. ligniniphilus, B. litoralis, B. locisalis, B. luciferensis, B. luteolus, B. luteus, B. macauensis, B. macerans, B. macquariensis, B. macyae, B. malacitensis, B. mannanilyticus, B. marisflavi, B. marismortui, B. marmarensis, B. massiliensis, B. megaterium, B. mesonae, B. methanolicus, B. methylotrophicus, B. migulanus, B. mojavensis, B. mucilaginosus, B. muralis, B. murimartini, B. mycoides, B. naganoensis, B. nanhaiensis, B. nanhaiisediminis, B. nealsonii, B. neidei, B. neizhouensis, B. niabensis, B. niacini, B. novalis, B. oceanisediminis, B. odysseyi, B. okhensis, B. okuhidensis, B. oleronius, B. oryzaecorticis, B. oshimensis, B. pabuli, B. pakistanensis, B. pallidus, B. pallidus, B. panacisoli, B. panaciterrae, B. pantothenticus, B. parabrevis, B. paraflexus, B. pasteurii, B. patagoniensis, B. peoriae, B. persepolensis, B. persicus, B. pervagus, B. plakortidis, B. pocheonensis, B. polygoni, B. polymyxa, B. popilliae, B. pseudalcalophilus, B. pseudofirmus, B. pseudomycoides, B. psychrodurans, B. psychrophilus, B. psychrosaccharolyticus, B. psychrotolerans, B. pulvifaciens, B. pumilus, B. purgationiresistens, B. pycnus, B. qingdaonensis, B. qingshengii, B. reuszeri, B. rhizosphaerae, B. rigui, B. ruris, B. safensis, B. salarius, B. salexigens, B. saliphilus, B. schlegelii, B. sediminis, B. selenatarsenatis, B. selenitireducens, B. seohaeanensis, B. shacheensis, B. shackletonii, B. siamensis, B. silvestris, B. simplex, B. siralis, B. smithii, B. soli, B. solimangrovi, B. solisalsi, B. songklensis, B. sonorensis, B. sphaericus, B. sporothermodurans, B. stearothermophilus, B. stratosphericus, B. subterraneus, B. subtilis, B. taeanensis, B. tequilensis, B. thermantarcticus, B. thermoaerophilus, B. thermoamylovorans, B. thermocatenulatus, B. thermocloacae, B. thermocopriae, B. thermodenitrificans, B. thermoglucosidasius, B. thermolactis, B. thermoleovorans, B. thermophilus, B. thermoruber, B. thermosphaericus, B. thiaminolyticus, B. thioparans, B. thuringiensis, B. tianshenii, B. trypoxylicola, B. tusciae, B. validus, B. vallismortis, B. vedderi, B. velezensis, B. vietnamensis, B. vireti, B. vulcani, B. wakoensis, B. weihenstephanensis, B. xiamenensis, B. xiaoxiensis, and B. zhanjiangensis*. In some embodiments, the *Bacillus* cell is *Bacillus subtilis, Bacillus megaterium, Bacillus anthracis*, or *Bacillus brevis*.

In some embodiments, the *Bacillus subtilis, Bacillus megaterium*, and *Bacillus anthracis*, and *Bacillus brevis*.

In some embodiments, the *Bacillus* cell is a wild-type cell (i.e., unmodified genetically). In some embodiments, the *Bacillus* cell is engineered to be protease deficient (e.g., by inactivating one or more genes encoding proteases in the *Bacillus* cell). Protease deficient *Bacillus* have been described for expressing recombinant proteins, e.g., in Fahnestock et al., Appl Environ Microbiol. 1987 February; 53(2): 379-384, incorporated herein by reference.

TABLE 1

Exemplary, non-limiting BoNT amino acid sequences

| SEQ ID NO | Description | Sequence |
|---|---|---|
| 1 | Wild-type<br>BoNT/B1,<br>Okra strain | MPVTINNFNYNDPIDNNNIIMMEPPFARGTGRYYKAFKITDRIWIIPERYTFGYKPE<br>DFNKSSGIFNRDVCEYYDPDYLNTNDKKNIFLQTMIKLFNRIKSKPLGEKLLEMII<br>NGIPYLGDRRVPLEEFNTNIASVTVNKLISNPGEVERKKGIFANLIIFGPGPVLNEN<br>ETIDIGIQNHFASREGFGGIMQMKFCPEYVSVFNNVQENKGASIFNRRGYFSDPAL<br>ILMHELIHVLHGLYGIKVDDLPIVPNEKKFFMQSTDAIQAEELYTFGGQDPSIITPS<br>TDKSIYDKVLQNFRGIVDRLNKVLVCISDPNININIYKNKFKDKYKFVEDSEGKYS<br>IDVESFDKLYKSLMFGFTETNIAENYKIKTRASYFSDSLPPVKIKNLLDNEIYTIEEG<br>FNISDKDMEKEYRGQNKAINKQAYEEISKEHLAVYKIQMCKSVKAPGICIDVDNE<br>DLFFIADKNSFSDDLSKNERIEYNTQSNYIENDFPINELILDTDLISKIELPSENTESL<br>TDFNVDVPVYEKQPAIKKIFTDENTIFQYLYSQTFPLDIRDISLTSSFDDALLFSNK<br>VYSFFSMDYIKTANKVVEAGLFAGWVKQIVNDFVIEANKSNTMDKIADISLIVPYI<br>GLALNVGNETAKGNFENAFEIAGASILLEFIPELLIPVVGAFLLESYIDNKNKIIKTI<br>DNALTKRNEKWSDMYGLIVAQWLSTVNTQFYTIKEGMYKALNYQAQALEEIIK<br>YRYNIYSEKEKSNINIDFNDINSKLNEGINQAIDNINNFINGCSVSYLMKKMIPLAV<br>EKLLDFDNTLKKNLLNYIDENKLYLIGSAEYEKSKVNKYLKTIMPFDLSIYTNDTI<br>LIEMFNKYNSEILNNIILNLRYKDNNLIDLSGYGAKVEVYDGVELNDKNQFKLTSS<br>ANSKIRVTQNQNIIFNSVFLDFSVSFWIRIPKYKNDGIQNYIHNEYTIINCMKNNSG<br>WKISIRGNRIIWTLIDINGKTKSVFFEYNIREDISEYINRWFFVTITNNLNNAKIYIN<br>GKLESNTDIKDIREVIANGEIIFKLDGDIDRTQFIWMKYFSIFNTELSQSNIEERYKI<br>QSYSEYLKDFWGNPLMYNKEYYMFNAGNKNSYIKLKKDSPVGEILTRSKYNQNS<br>KYINYRDLYIGEKFIIRRKSNSQSINDDIVRKEDYIYLDFFNLNQEWRVYTYKYFK<br>KEEEKLFLAPISDSDEFYNTIQIKEYDEQPTYSCQLLFKKDEESTDEIGLIGIHRFYE<br>SGIVFEEYKDYFCISKWYLKEVKRKPYNLKLGCNWQFIPKDEGWTE |
| 2 | Wild-type<br>BoNT/B2,<br>111 strain | MPVTINNFNYNDPIDNNNIIMMEPPFARGTGRYYKAFKITDRIWIIPERYTFGYKPE<br>DFNKSSGIFNRDVCEYYDPDYLNTNDKKNIFLQTMIKLFNRIKSKPLGEKLLEMII<br>NGIPYLGDRRVPLEEFNTNIASVTVNKLISNPGEVERKKGIFANLIIFGPGPVLNEN<br>ETIDIGIQNHFASREGFGGIMQMKFCPEYVSVFNNVQENKGASIFNRRGYFSDPAL<br>ILMHELIHVLHGLYGIKVDDLPIVPNEKKFFMQSTDAIQAEELYTFGGQDPSIITPS<br>TDKSIYDKVLQNFRGIVDRLNKVLVCISDPNININIYKNKFKDKYKFVEDSEGKYS<br>IDVESFDKLYKSLMFGFTETNIAENYKIKTRASYFSDSLPPVKIKNLLDNEIYTIEEG<br>FNISDKNMEKEYRGQNKAINKQAYEEISKEHLAVYKIQMCKSVRAPGICIDVDNE<br>DLFFIADKNSFSDDLSKNERIEYDTQSNYIENRSSIDELILDTNLISKIELPSENTESL<br>TDFNVDVPVYEKQPAIKKIFTDENTIFQYLYSQTFPLDIRDISLTSSFDDALLFSNK<br>VYSFFSMDYIKTANKVVEAGLFAGWVKQIVDDFVIEANKSSTMDKIADISLIVPYI<br>GLALNVGNETAKGNFENAFEIAGASILLEFIPELLIPVVGAFLLESYIDNKNKIIKTI<br>DNALTKRDEKWIDMYGLIVAQWLSTVNTQFYTIKEGMYKALNYQAQALEEIIKY<br>KYNIYSEKEKSNINIDFNDINSKLNEGINQAVDNINNFINECSVSYLMKKMIPLAVE<br>KLLDFDNTLKKNLLNYIDENKLYLIGSAEYEKSKVDKHLKTIIPFDLSMYTNNTILI<br>EIFNKYNSEILNNIILNLRYRDNNLIDLSGYGANVEVYDGVELNDKNQFKLTSSTN<br>SEIRVTQNQNIIFNSMFLDFSVSFWIRIPKYKNDGIQNYIHNEYTIINCIKNNSGWKI<br>SIRGNRIIWTLTDINGKTKSVFFEYSIREDISDYINRWFFVTITNNSDNAKIYINGKL<br>ESNIDIKDIGEVIANGEIIFKLDGDIDRTQFIWMKYFSIFNTELSQSNIKEIYKIQSYS<br>EYLKDFWGNPLMYNKEYYMFNAGNKNSYIKLKKDSSVGEILTRSKYNQNSNYIN<br>YRNLYIGEKFIIRRKSNSQSINDDIVRKEDYIYLDFFNSNREWRVYAYKDFKEEEK<br>KLFLANIYDSNEFYKTIQIKEYDEQPTYSCQLLFKKDEESTDEIGLIGIHRFYESGIV<br>LKDYKNYFCISKWYLKEVKRKPYNPNLGCNWQFIPKDEGWIE |
| 3 | Wild-type<br>BoNT/B3,<br>CDC795<br>strain | MPVTINNFNYNDPIDNDNIIMMEPPFARGTGRYYKAFKITDRIWIIPERYTFGYKPE<br>DFNKSSGIFNRDVCEYYDPDYLNTNDKKNIFLQTMIKLFNRIKSKPLGEKLLEMII<br>NGIPYLGDRRVPLEEFNTNIASVTVNKLISNPGEVERKKGIFANLIIFGPGPVLNEN<br>ETIDIGIQNHFASREGFGGIMQMKFCPEYVSVFNNVQENKGASIFNRRGYFSDPAL<br>ILMHELIHVLHGLYGIKVDDLPIVPNEKKFFMQSTDAIQAEELYTFGGQDPRIITPS<br>TDKSIYDKVLQNFRGIVDRLNKVLVCISDPNININIYKNKFKDKYKFVEDSEGKYS<br>IDVESFDKLYKSLMFGFTETNIAENYKIKTRASYFSDSLPPVKIKNLLDNEIYTIEEG<br>FNISDKNMEKEYRGQNKAINKQAYEEISKEHLAVYKIQMCKSVRAPGICIDVDNE<br>DLFFIADKNSFSDDLSKNERIEYDTQSNYIENRSSIDELILDTNLISKIELPSENTESL<br>TDFNVDVPVYEKQPAIKKIFTDENTIFQYLYSQTFPLDIRDISLTSSFDDALLFSNK<br>VYSFFSMDYIKTANKVVEAGLFAGWVKQIVDDFVIEANKSSTMDKIADISLIVPYI<br>GLALNVGNETAKGNFENAFEIAGASILLEFIPELLIPVVGAFLLESYIDNKNKIIKTI<br>DNALTKRDEKWIDMYGLIVAQWLSTVNTQFYTIKEGMYKALNYQAQALEEIIKY<br>KYNIYSEKEKSNINIDFNDINSKLNEGINQAIDNINNFINECSVSYLMKKMIPLAVE<br>KLLDFDNTLKKNLLNYIDENKLYLIGSAEYEKSKVDKHLKTIIPFDLSMYTNNTILI<br>EIFNKYNSEILNNIILNLRYRDNNLIDLSGYGAKVEVYNGVELNDKNQFKLTSSAN<br>SKIRVTQNQDIIFNSMFLDFSVSFWIRIPKYKNDGIQNYIHNEYTIINCIKNNSGWKI<br>SIRGNKIIWTLTDINGKTKSVFFEYSIRKDVSEYINRWFFVTITNNSDNAKIYINGKL<br>ESNIDIKDIGEVIANGEIIFKLDGDIDRTQFIWMKYFSIFNTELSQSNIKEIYKIQSYS<br>EYLKDFWGNPLMYNKEYYMFNAGNKNSYIKLKKDSSVGEILTRSKYNQNSNYIN<br>YRNLYIGEKFIIRRKSNSQSINDDIVRKEDYIYLDFFNLNQEWRVYAYKDFKKKEE<br>KLFLANIYDSNEFYNTIQIKEYDEQPTYSCQLLFKKDEESTDEIGLIGIHRFYESGIV<br>FKDYKDYFCISKWYLKEVKRKPYNPNLGCNWQFIPKDEGWIE |
| 4 | Wild-type<br>BoNT/B4, | MPVTINNFNYNDPIDNDNIIMMEPPFARGTGRYYKAFKITDRIWIIPERYTFGYKPE<br>DFNKSSGIFNRDVCEYYDPDYLNTNDKKNIFLQTMIKLFNRIKSKPLGEKLLEMII |

TABLE 1-continued

| SEQ ID NO | Description | Sequence |
|---|---|---|
| | Exemplary, non-limiting BoNT amino acid sequences | |
| | Eklund 17B strain | NGIPYLGDRRVPLEEFNTNIASVTVNKLISNPGEVEQKKGIFANLIIFGPGPVLNEN<br>ETIDIGIQNHFASREGFGGIMQMKFCPEYVSVFNNVQENKGASIFNRRGYFSDPAL<br>ILMHELIHVLHGLYGIKVDDLPIVPNEKKFFMQSTDTIQAEELYTFGGQDPSIISPST<br>DKSIYDKVLQNFRGIVDRLNKVLVCISDPNININIYKNKFKDKYKFVEDSEGKYSI<br>DVESFNKLYKSLMFGFTEINIAENYKIKTRASYFSDSLPPVKIKNLLDNEIYTIEEGF<br>NISDKNMGKEYRGQNKAINKQAYEEISKEHLAVYKIQMCKSVKVPGICIDVDNE<br>NLFFIADKNSFSDDLSKNERVEYNTQNNYIGNDFPINELILDTDLISKIELPSENTES<br>LTDFNVDVPVYEKQPAIKKVFTDENTIFQYLYSQTFPLNIRDISLTSSFDDALLVSS<br>KVYSFFSMDYIKTANKVVEAGLFAGWVKQIVDDFVIEANKSSTMDKIADISLIVP<br>YIGLALNVGDETAKGNFESAFEIAGSSILLEFIPELLIPVVGVFLLESYIDNKNKIIKT<br>IDNALTKRVEKWIDMYGLIVAQWLSTVNTQFYTIKEGMYKALNYQAQALEEIIK<br>YKYNIYSEEEKSNININFNDINSKLNDGINQAMDNINDFINECSVSYLMKKMIPLA<br>VKKLLDFDNTLKKNLLNYIDENKLYLIGSVEDEKSKVDKYLKTIIPFDLSTYTNNE<br>ILIKIFNKYNSEILNNIILNLRYRDNNLIDLSGYGAKVEVYDGVKLNDKNQFKLTSS<br>ADSKIRVTQNQNIIFNSMFLDFSVSFWIRIPKYRNDDIQNYIHNEYTIINCMKNNSG<br>WKISIRGNRIIWTLIDINGKTKSVFFEYNIREDISEYINRWFFVTITNNLDNAKIYIN<br>GTLESNMDIKDIGEVIVNGEITFKLDGDVDRTQFIWMKYFSIFNTQLNQSNIKEIYK<br>IQSYSEYLKDFWGNPLMYNKEYYMFNAGNKNSYIKLVKDSSVGEILIRSKYNQN<br>SNYINYRNLYIGEKFIIRRKSNSQSINDDIVRKEDYIHLDFVNSNEEWRVYAYKNF<br>KEQEQKLFLSIIYDSNEFYKTIQIKEYDEQPTYSCQLLFKKDEESTDDIGLIGIHRFY<br>ESGVLRKKYKDYFCISKWYLKEVKRKPYKSNLGCNWQFIPKDEGWTE |
| 5 | Wild-type BoNT/B5, CDC795 strain | MPVTINNFNYNDPIDNNNIIMMEPPFARGMGRYYKAFKITDRIWIIPERYTFGYKP<br>EDFNKSSGIFNRDVCEYYDPDYLNTNDKKNIFLQTMIKLFNRIKSKPLGEKLLEMII<br>NGIPYLGDRRVPLEEFNTNIASVTVNKLISNPGEVERKKGIFANLIIFGPGPVLNEN<br>ETIDIGIQNHFASREGFGGIMQMKFCPEYVSVFNNVQENKGASIFNRRGYFSDPAL<br>ILMHELIHVLHGLYGIKVNDLPIVPNEKKFFMQSTDAIQAEELYTFGGQDPSIISPS<br>TDKSIYDKVLQNFRGIVDRLNKVLVCISDPNININIYKNKFKDKYKFVEDSEGKYS<br>IDVESFDKLYKSLMFGFTETNIAENYKIKTRASYFSDSLPPVKIKNLLDNEIYTIEEG<br>FNISDKNMEKEYRGQNKAINKQAYEEISKEHLAVYKIQMCKSVKAPGICIDVDNE<br>DLFFIADKNSFSDDLSKNERIAYNTQNNYIENDFSINELILDTDLISKIELPSENTESL<br>TDFNVYVPVYKKQPAIKKIFTDENTIFQYLYSQTFPLDIRDISLTSSFDDALLFSNK<br>VYSFFSMDYIKTANKVVEAGLFAGWVKQIVDDFVIEANKSSTMDKIADISLIVPYI<br>GLALNVGNETAKGNFENAFEIAGASILLEFIPELLIPVVGAFLLESYIDNKNKIIETI<br>NSALTKRDEKWIDMYGLIVAQWLSTVNTQFYTIKEGMYKALNYQAQALEEIIKY<br>KYNIYSEKERSNINIDFNDVNSKLNEGINQAIDNINNFINECSVSYLMKKMIPLAVE<br>KLLDFDNTLRKNLLNYIDENKLYLIGSAEYEKSKVDKYLKTSIPFDLSTYTNNTILI<br>EIFNKYNSDILNNIILNLRYRDNKLIDLSGYGAKVEVYDGVKLNDKNQFKLTSSA<br>NSKIRVIQNQNIIFNSMFLDFSVSFWIRIPKYKNDGIQNYIHNEYTIINCMKNNSGW<br>KISIRGNMIIWTLIDINGKIKSVFFEYSIKEDISEYINRWFFVTITNNSDNAKIYINGK<br>LESHIDIRDIREVIANDEIIFKLDGNIDRTQFIWMKYFSIFNTELSQSNIEEIYKIQSYS<br>EYLKDFWGNPLMYNKEYYMFNAGNKNSYIKLKKDSSVGEILTRSKYNQNSKYIN<br>YRDLYIGEKFIIRRKSNSQSINDDIVRKEDYIYLDFFNLNQEWRVYMYKYFKKEEE<br>KLFLAPISDSDEFYNTIQIKEYDEQPTYSCQLLFKKDEESTDEIGLIGIHRFYESGIVF<br>KEYKDYFCISKWYLKEVKRKPYNSKLGCNWQFIPKDEGWTE |
| 6 | Wild-type BoNT/B6, Osaka05 strain | MPVTINNFNYNDPIDNNNIIMMEPPFARGTGRYYKAFKITDRIWIIPERYTFGYKPE<br>DFNKSSGIFNRDVCEYYDPDYLNTNDKKNIFLQTMIKLFNRIKSKPLGEKLLEMII<br>NGIPYLGDRRVPLEEFNTNIASVTVNKLISNPGEVERKKGIFANLIIFGPGPVLNEN<br>ETIDIGIQNHFASREGFGGIMQMKFCPEYVSVFNNVQENKGASIFNRRGYFSDPAL<br>ILMHELIHVLHGLYGIKVDDLPIVPNEKKFFMQSTDAIQAEELYTFGGQDPSIITPS<br>TDKSIYDKVLQNFRGIVDRLNKVLVCISDPNININIYKNKFKDKYKFVEDSEGKYS<br>IDVESFDKLYKSLMFGFTETNIAENYKIKTRASYFSDSLPPVKIKNLLDNEIYTIEEG<br>FNISDKNMEKEYRGQNKAINKQAYEEISKEHLAVYKIQMCKSVRAPGICIDVDNE<br>DLFFIADKNSFSDDLSKNERIEYDTQSNYIENRSSIDELILDTNLISKIELPSENTESL<br>TDFNVDVPVYEKQPAIKKFFTDENTIFQYLYSQTFPLDIRDISLTSSFDDALLFSNK<br>VYSFFSMDYIKTANKVVEAGLFAGWVKQIVDDFVIEANKSNTMDKLADISLIVPY<br>IGLALNVGNETAKGNFENAFEIAGASILLEFIPELLIPVVGAFLLESYIDNKNKIIKTI<br>DNALTKRDEKWRDMYGLIVAQWLSTVNTQFYTIKEGMYKALNYQAQALEEIIK<br>YKYNIYSEKEKSNINIDFNDINSKLNEGINQAIDNINNFINECSVSYLMKKMIPLAV<br>EKLLDFDNTLKKNLLNYIDENKLYLIGSAEYEKSKVDKHLKTIIPFDLSMYTNNTI<br>LIEIFKKYNSEILNNIILNLRYRDNNLIDLSGYGANVEVYDGVELNDKNQFKLTSST<br>NSEIRVTQNQNIIFNSMFLDFSVSFWIRIPKYKNDGIQNYIHNEYTIINCIKNNSGW<br>KISIRGNRIIWTLTDINGKTKSVFFEYSIREDISDYINRWFFVTITNNSDNAKIYINGK<br>LESNIDIKDIGEVIANGEIIFKLDGDIDRTQFIWMKYFSIFNTELSQSNIKEIYKIQSY<br>SEYLKDFWGNPLMYNKEYYMFNAGNKNSYIKLKKDSPVGEILTRSKYNQNSNYI<br>NYRNLYIGEKFIIRRKSNSQSINDDIVRKEDYIYLDFFNLNQEWRVYALKNFKKKE<br>EKLFLAPISDSDEFYNTIQIKEYDEQPTYSCQLLFKKDEESTDEIGLIGIHRFYESGIV<br>FKDYKYYFCISKWYLKEVKRKPYNPNLGCNWQFIPKDEGWIE |
| 7 | Wild-type BoNT/B7, Bac-04-07755 strain | MPVTINNFNYNDPIDNNNIIMMEPPFARGTGRYYKAFKITDRIWIIPERYTFGYKPE<br>DFNKSSGIFNRDVCEYYDPDYLNTNDKKNIFLQTMIKLFNRIKSKPLGEKLLEMII<br>NGIPYLGDRRVPLEEFNTNIASVTVNKLISNPGEVERKKGIFANLIIFGPGPVLNEN<br>ETIDIGIQNHFASREGFGGIMQMKFCPEYVSVFNNVQENKGASIFNRRGYFSDPAL |

TABLE 1-continued

| Exemplary, non-limiting BoNT amino acid sequences | | |
|---|---|---|
| SEQ ID NO | Description | Sequence |
| | | ILMHELIHVLHGLYGIKVDDLPIVPNEKKFFMQSTDAIQAEELYTFGGQDPSIITPS<br>TDKSIYDKVLQNFRGIVDRLNKVLVCISDPNININIYKNKFKDKYKFVEDSEGKYS<br>IDVESFDKLYKSLMFGFTETNIAENYKIKTRASYFSDSLPPVKIKNLLDNEIYTIEEG<br>FNISDKDMEKEYRGQNKAINKQAYEEISKEHLAVYKIQMCKSVKAPGICIDVDNE<br>DLFFIADKNSFSDDLSKNERIEYNTKNIYIENYFSINELILDTDLISGIELPSENTESLT<br>DFNVDVPVYEKQPAIKKIFTDENTIFQYLYSQTFPLDIRDISLTSSFDDALLFSNKV<br>YSFFSMDYIKTANKVVEAGLFAGWVKQIIDDFVIEANKSSTMDKIADISLIVPYIGL<br>ALNVGNETAKGNFENAFEIAGASILLEFIPELLIPVVGAFLLESYIDNKNKIIKTIDN<br>ALTKRVEKWIDMYGLIVAQWLSTVNTQFYTIKEGMYKALNYQAQALEEIIKYKY<br>NIYSEKEKLNINIDFNDINSKLNEGINQAIDNINNFINECSVSYLMKKMIPLAIEKLL<br>DFDNALKKNLLNYIDENKLYLIGSVEEEKSKVDKFFKTIIPFDLSMYTNNTILIEMV<br>NKYNSEILNNIILNLRYRDNNLIDSSGYGAKVEVYNGVELNDKNQFKLTSSANSKI<br>KVTQNQNITFNSMFLDFSVSFWIRIPKYKNDGIQNYIHNEYTIINCMKNNSGWKISI<br>RGNRIIWTLTDINGKTKSVFFEYSIREDISDYINRWFFVTITNNLDNAKIYINGKLES<br>NIDIRDIREVIVNGEIIFKLDGEIDRTQFIWMKYFSIFNTELSQSNVKEIYKIQSYSKY<br>LKDFWGNPLMYNKEYYMFNAGNKNSYIKLVKDSSVGEILTRSKYNQNSNYINYR<br>NLYIGEKFIIRRKSSSQSISDDIVRKEDYIYLDFFNSNREWRVYAYKNFKGQEEKLF<br>LANIYDSNEFYKTIQIKEYDEQPTYSCQLLFKKDEESTDEIGLIGIHNFYESGILFKD<br>YKDYFCISKWYLKEVKKKPYSSNLGCNWQFIPKDEGWTE |
| 8 | Wild-type BoNT/B8, Maehongson strain | MPVTINNFNYNDPIDNNNIIMMEPPFARGTGRYYKAFKITDRIWIIPERYTFGYKPE<br>DFNKSSGIFNRDVCEYYDPDYLNTNDKKNIFLQTMIKLFNRIKSKPLGEKLLEMII<br>NGIPYLGDRRVPLEEFNTNIASVTVNKLISNPGGEERKEGIFANLIIFGPGPVLNENE<br>TIDIGIQNHFASREGFGGIMQMKFCPEYVSVFNNVQENKGASIFNRRGYFSDPALI<br>LMHELIHVLHGLYGIKVDDLPIVPNGKKFFMQSTDAIQAEELYTFGGQDPSIITPST<br>DKSIYDKVLQNFRGIVDRLNKVLVCISDPNININIYKNKFKDKYKFVEDSEGKYSI<br>DVESFDKLYKSLMFGFTETNIAENYKIKTRASYFSDSLPPVKIKNLLDDEIYTIEEG<br>FNISDKNMGKEYRGQNKAINKQAYEEISKEHLAVYKIQMCKSVRAPGICIDVDNE<br>DLFFIADKNSFSDDLSKNERIEYNTQSNYIENDFSINELILDTDLISKIELPSENTESL<br>TDFNVDVPVYEKQPAIKKIFTDENTIFQYLYSQTFPLDIRDISLTSSFDDALLFSNK<br>VYSFFSMDYIKTANKVVEAGLFAGWVKQIVDDFVIEANKSNTMDKIADISLIVPYI<br>GLALNVGNETAKGNFENAFEIAGSSILLEFIPELLIPVVGAFLLESYIDNKNKIIKTI<br>DNALTKRDEKWIDMYGLIVAQWLSTVNTQFYTIKEGMYKALNYQAQALEEIIKY<br>KYNIYSEKEKSNISIDFNDINSKLNEGINQAIDNINDFINECSVSYLMKKMIPLAVE<br>KLLDFDNTLKKNLLNYIDENKLYLIGSAEYEKSKVDKHLKTIMTFDLSMYTNNTI<br>LIKMVNKYNSEILNNIILNLRYRDNNLIDLSGYGANVEVYDGVELNDKNQFKLTS<br>STNSEIRVTQNQNIIVNSMFLDFSVSFWIRIPKYKNDGIQNYIHNEYTIINCMKNNS<br>GWKISIRGNRIIWTLIDINGKIKSVFFEYSIRKDVSEYINRWFFVTITNNLDNAKIYI<br>NGKLESNMDIRDIREVIANGEIIFKLDGDIDRTQFIWMKYFSIFNTELSQSNIEEIYKI<br>QSYSEYLKDFWGNPLMYNKEYYMFNAGSKNSYIKLKKDSSVGEILTRSKYNQNS<br>QYINYRDLYIGEKFIIKRKSNSQSINDDIVRKEDYIYLDFFNLNQEWRVYAYKDFK<br>GQKEQKLFLANIHDSNEFYKTIQIKEYDEQPTYSCQLLFKKDEESTDEIGLIGIHRF<br>YESGFVFQEYKYYFCISKWYLKEVKKKPYNPDLGCNWQFIPKDEGWTE |
| 9 | Wild-type BoNT/B1 receptor binding domain (860-1291) | ILNNIILNLRYKDNNLIDLSGYGAKVEVYDGVELNDKNQFKLTSSANSKIRVTQN<br>QNIIFNSVFLDFSVSFWIRIPKYKNDGIQNYIHNEYTIINCMKNNSGWKISIRGNRII<br>WTLIDINGKTKSVFFEYNIREDISEYINRWFFVTITNNLNNAKIYINGKLESNTDIK<br>DIREVIANGEIIFKLDGDIDRTQFIWMKYFSIFNTELSQSNIEERYKIQSYSEYLKDF<br>WGNPLMYNKEYYMFNAGNKNSYIKLKKDSPVGEILTRSKYNQNSKYINYRDLYI<br>GEKFIIRRKSNSQSINDDIVRKEDYIYLDFFNLNQEWRVYTYKYFKKEEEKLFLAPI<br>SDSDEFYNTIQIKEYDEQPTYSCQLLFKKDEESTDEIGLIGIHRFYESGIVFEEYKDY<br>FCISKWYLKEVKRKPYNLKLGCNWQFIPKDEGWTE |
| 10 | Wild-type BoNT/B2 receptor binding domain (860-1291) | ILNNIILNLRYRDNNLIDLSGYGANVEVYDGVELNDKNQFKLTSSTNSEIRVTQNQ<br>NIIFNSMFLDFSVSFWIRIPKYKNDGIQNYIHNEYTIINCIKNNSGWKISIRGNRIIWT<br>LTDINGKTKSVFFEYSIREDISDYINRWFFVTITNNSDNAKIYINGKLESNIDIKDIG<br>EVIANGEIIFKLDGDIDRTQFIWMKYFSIFNTELSQSNIKEIYKIQSYSEYLKDFWGN<br>PLMYNKEYYMFNAGNKNSYIKLKKDSSVGEILTRSKYNQNSNYINYRNLYIGEKF<br>IIRRKSNSQSINDDIVRKEDYIYLDFFNSNREWRVYAYKDFKEEEKKLFLANIYDS<br>NEFYKTIQIKEYDEQPTYSCQLLFKKDEESTDEIGLIGIHRFYESGIVLKDYKNYFCI<br>SKWYLKEVKRKPYNPNLGCNWQFIPKDEGWIE |
| 11 | Wild-type BoNT/B3 receptor binding domain (860-1291) | ILNNIILNLRYRDNNLIDLSGYGAKVEVYNGVELNDKNQFKLTSSANSKIRVTQN<br>QDIIFNSMFLDFSVSFWIRIPKYKNDGIQNYIHNEYTIINCIKNNSGWKISIRGNKII<br>WTLTDINGKTKSVFFEYSIRKDVSEYINRWFFVTITNNSDNAKIYINGKLESNIDIK<br>DIGEVIANGEIIFKLDGDIDRTQFIWMKYFSIFNTELSQSNIKEIYKIQSYSEYLKDF<br>WGNPLMYNKEYYMFNAGNKNSYIKLKKDSSVGEILTRSKYNQNSNYINYRNLYI<br>GEKFIIRRKSNSQSINDDIVRKEDYIYLDFFNLNQEWRVYAYKDFKKKEEKLFLAN<br>IYDSNEFYNTIQIKEYDEQPTYSCQLLFKKDEESTDEIGLIGIHRFYESGIVFKDYKD<br>YFCISKWYLKEVKRKPYNPNLGCNWQFIPKDEGWIE |
| 12 | Wild-type BoNT/B4 receptor | ILNNIILNLRYRDNNLIDLSGYGAKVEVYDGVKLNDKNQFKLTSSADSKIRVTQN<br>QNIIFNSMFLDFSVSFWIRIPKYRNDDIQNYIHNEYTIINCMKNNSGWKISIRGNRII<br>WTLIDINGKTKSVFFEYNIREDISEYINRWFFVTITNNLDNAKIYINGTLESNMDIK |

TABLE 1-continued

Exemplary, non-limiting BoNT amino acid sequences

| SEQ ID NO | Description | Sequence |
|---|---|---|
| | binding<br>domain<br>(860-1291) | DIGEVIVNGEITFKLDGDVDRTQFIWMKYFSIFNTQLNQSNIKEIYKIQSYSEYLKD<br>FWGNPLMYNKEYYMFNAGNKNSYIKLVKDSSVGEILIRSKYNQNSNYINYRNLY<br>IGEKFIIRRKSNSQSINDDIVRKEDYIHLDFVNSNEEWRVYAYKNFKEQEQKLFLSI<br>IYDSNEFYKTIQIKEYDEQPTYSCQLLFKKDEESTDDIGLIGIHRFYESGVLRKKYK<br>DYFCISKWYLKEVKRKPYKSNLGCNWQFIPKDEGWTE |
| 13 | Wild-type<br>BoNT/B5<br>receptor<br>binding<br>domain<br>(860-1291) | ILNNIILNLRYRDNKLIDLSGYGAKVEVYDGVKLNDKNQFKLTSSANSKIRVIQNQ<br>NIIFNSMFLDFSVSFWIRIPKYKNDGIQNYIHNEYTIINCMKNNSGWKISIRGNMII<br>WTLIDINGKIKSVFFEYSIKEDISEYINRWFFVTITNNSDNAKIYINGKLESHIDIRDI<br>REVIANDEIIFKLDGNIDRTQFIWMKYFSIFNTELSQSNIEEIYKIQSYSEYLKDFWG<br>NPLMYNKEYYMFNAGNKNSYIKLKKDSSVGEILTRSKYNQNSKYINYRDLYIGE<br>KFIIRRKSNSQSINDDIVRKEDYIYLDFFNLNQEWRVYMYKYFKKEEEKLFLAPIS<br>DSDEFYNTIQIKEYDEQPTYSCQLLFKKDEESTDEIGLIGIHRFYESGIVFKEYKDY<br>FCISKWYLKEVKRKPYNSKLGCNWQFIPKDEGWTE |
| 14 | Wild-type<br>BoNT/B6<br>receptor<br>binding<br>domain<br>(860-1291) | ILNNIILNLRYRDNNLIDLSGYGANVEVYDGVELNDKNQFKLTSSTNSEIRVTQNQ<br>NIIFNSMFLDFSVSFWIRIPKYKNDGIQNYIHNEYTIINCIKNNSGWKISIRGNRIIWT<br>LTDINGKTKSVFFEYSIREDISDYINRWFFVTITNNSDNAKIYINGKLESNIDIKDIG<br>EVIANGEIIFKLDGDIDRTQFIWMKYFSIFNTELSQSNIKEIYKIQSYSEYLKDFWGN<br>PLMYNKEYYMFNAGNKNSYIKLKKDSPVGEILTRSKYNQNSNYINYRNLYIGEKF<br>IIRRKSNSQSINDDIVRKEDYIYLDFFNLNQEWRVYALKNFKKKEEKLFLAPISDSD<br>EFYNTIQIKEYDEQPTYSCQLLFKKDEESTDEIGLIGIHRFYESGIVFKDYKYYFCIS<br>KWYLKEVKRKPYNPNLGCNWQFIPKDEGWIE |
| 15 | Wild-type<br>BoNT/B7<br>receptor<br>binding<br>domain<br>(860-1291) | ILNNIILNLRYRDNNLIDSSGYGAKVEVYNGVELNDKNQFKLTSSANSKIKVTQN<br>QNITFNSMFLDFSVSFWIRIPKYKNDGIQNYIHNEYTIINCMKNNSGWKISIRGNRII<br>WTLTDINGKTKSVFFEYSIREDISDYINRWFFVTITNNLDNAKIYINGKLESNIDIRD<br>IREVIVNGEIIFKLDGEIDRTQFIWMKYFSIFNTELSQSNVKEIYKIQSYSKYLKDFW<br>GNPLMYNKEYYMFNAGNKNSYIKLVKDSSVGEILTRSKYNQNSNYINYRNLYIG<br>EKFIIRRKSSSQSISDDIVRKEDYIYLDFFNSNREWRVYAYKNFKGQEEKLFLANIY<br>DSNEFYKTIQIKEYDEQPTYSCQLLFKKDEESTDEIGLIGIHNFYESGILFKDYKDY<br>FCISKWYLKEVKKKPYSSNLGCNWQFIPKDEGWTE |
| 16 | Wild-type<br>BoNT/B8<br>receptor<br>binding<br>domain<br>(860-1291) | ILNNIILNLRYRDNNLIDLSGYGANVEVYDGVELNDKNQFKLTSSTNSEIRVTQNQ<br>NIIVNSMFLDFSVSFWIRIPKYKNDGIQNYIHNEYTIINCMKNNSGWKISIRGNRIIW<br>TLIDINGKIKSVFFEYSIRKDVSEYINRWFFVTITNNLDNAKIYINGKLESNMDIRDI<br>REVIANGEIIFKLDGDIDRTQFIWMKYFSIFNTELSQSNIEEIYKIQSYSEYLKDFWG<br>NPLMYNKEYYMFNAGSKNSYIKLKKDSSVGEILTRSKYNQNSQYINYRDLYIGEK<br>FIIKRKSNSQSINDDIVRKEDYIYLDFFNLNQEWRVYAYKDFKGQKEQKLFLANIH<br>DSNEFYKTIQIKEYDEQPTYSCQLLFKKDEESTDEIGLIGIHRFYESGFVFQEYKYY<br>FCISKWYLKEVKKKPYNPDLGCNWQFIPKDEGWTE |
| 17 | Chimeric<br>toxin<br>BoNT/A1<br>(1-872)-B1<br>(860-1291) | MPFVNKQFNYKDPVNGVDIAYIKIPNAGQMQPVKAFKIHNKIWVIPERDTFTNPE<br>EGDLNPPPEAKQVPVSYYDSTYLSTDNEKDNYLKGVTKLFERIYSTDLGRMLLTS<br>IVRGIPFWGGSTIDTELKVIDTNCINVIQPDGSYRSEELNLVIIGPSADIIQFECKSFG<br>HEVLNLTRNGYGSTQYIRFSPDFTFGFEESLEVDTNPLLGAGKFATDPAVTLAHEL<br>IHAGHRLYGIAINPNRVFKVNTNAYYEMSGLEVSFEELRTFGGHDAKFIDSLQEN<br>EFRLYYYNKFKDIASTLNKAKSIVGTTASLQYMKNVFKEKYLLSEDTSGKFSVDK<br>LKFDKLYKMLTEIYTEDNFVKFFKVLNRKTYLNFDKAVFKINIVPKVNYTIYDGF<br>NLRNTNLAANFNGQNTEINNMNFTKLKNFTGLFEFYKLLCVRGIITSKTKSLDKG<br>YNKALNDLCIKVNNWDLFFSPSEDNFTNDLNKGEEITSDTNIEAAEENISLDLIQQ<br>YYLTFNFDNEPENISIENLSSDIIGQLELMPNIERFPNGKKYELDKYTMFHYLRAQE<br>FEHGKSRIALTNSVNEALLNPSRVYTFFSSDYVKKVNKATEAAMFLGWVEQLVY<br>DFTDETSEVSTTDKIADITIIIPYIGPALNIGNMLYKDDFVGALIFSGAVILLEFIPEIA<br>IPVLGTFALVSYIANKVLTVQTIDNALSKRNEKWDEVYKYIVTNWLAKVNTQIDL<br>IRKKMKEALENQAEATKAIINYQYNQYTEEEKNNINFNIDDLSSKLNESINKAMIN<br>INKFLNQCSVSYLMNSMIPYGVKRLEDFDASLKDALLKYIYDNRGTLIGQVDRLK<br>DKVNNTLSTDIPFQLSKYVDNQRLLSTFTEYIKNILNNIILNLRYKDNNLIDLSGYG<br>AKVEVYDGVELNDKNQFKLTSSANSKIRVTQNQNIIFNSVFLDFSVSFWIRIPKYK<br>NDGIQNYIHNEYTIINCMKNNSGWKISIRGNRIIWTLIDINGKTKSVFFEYNIREDIS<br>EYINRWFFVTITNNLNNAKIYINGKLESNTDIKDIREVIANGEIIFKLDGDIDRTQFI<br>WMKYFSIFNTELSQSNIEERYKIQSYSEYLKDFWGNPLMYNKEYYMFNAGNKNS<br>YIKLKKDSPVGEILTRSKYNQNSKYINYRDLYIGEKFIIRRKSNSQSINDDIVRKED<br>YIYLDFFNLNQEWRVYTYKYFKKEEEKLFLAPISDSDEFYNTIQIKEYDEQPTYSC<br>QLLFKKDEESTDEIGLIGIHRFYESGIVFEEYKDYFCISKWYLKEVKRKPYNLKLG<br>CNWQFIPKDEGWTE |
| 18 | Chimeric<br>toxin<br>BoNT/A2<br>(1-872)-B1<br>(860-1291) | MPFVNKQFNYKDPVNGVDIAYIKIPNAGQMQPVKAFKIHNKIWVIPERDTFTNPE<br>EGDLNPPPEAKQVPVSYYDSTYLSTDNEKDNYLKGVTKLFERIYSTDLGRMLLTS<br>IVRGIPFWGGSTIDTELKVIDTNCINVIQPDGSYRSEELNLVIIGPSADIIQFECKSFG<br>HDVLNLTRNGYGSTQYIRFSPDFTFGFEESLEVDTNPLLGAGKFATDPAVTLAHE<br>LIHAEHRLYGIAINPNRVFKVNTNAYYEMSGLEVSFEELRTFGGHDAKFIDSLQEN<br>EFRLYYYNKFKDVASTLNKAKSIIGTTASLQYMKNVFKEKYLLSEDTSGKFSVDK<br>LKFDKLYKMLTEIYTEDNFVNFFKVINRKTYLNFDKAVFRINIVPDENYTIKDGFN |

TABLE 1-continued

Exemplary, non-limiting BoNT amino acid sequences

| SEQ ID NO | Description | Sequence |
|---|---|---|
| | | LKGANLSTNFNGQNTEINSRNFTRLKNFTGLFEFYKLLCVRGIIPFKTKSLDEGYN<br>KALNDLCIKVNNWDLFFSPSEDNFTNDLDKVEEITADTNIEAAEENISLDLIQQYY<br>LTFDFDNEPENISIENLSSDIIGQLEPMPNIERFPNGKKYELDKYTMFHYLRAQEFE<br>HGDSRIILTNSAEEALLKPNVAYTFFSSKYVKKINKAVEAFMFLNWAEELVYDFT<br>DETNEVTTMDKIADITIIVPYIGPALNIGNMLSKGEFVEAIIFTGVVAMLEFIPEYAL<br>PVFGTFAIVSYIANKVLTVQTINNALSKRNEKWDEVYKYTVTNWLAKVNTQIDLI<br>REKMKKALENQAEATKAIINYQYNQYTEEEKNNINFNIDDLSSKLNESINSAMINI<br>NKFLDQCSVSYLMNSMIPYAVKRLKDFDASVRDVLLKYIYDNRGTLVLQVDRLK<br>DEVNNTLSADIPFQLSKYVDNKKLLSTFTEYIKNILNNIILNLRYKDNNLIDLSGYG<br>AKVEVYDGVELNDKNQFKLTSSANSKIRVTQNQNIIFNSVFLDFSVSFWIRIPKYK<br>NDGIQNYIHNEYTIINCMKNNSGWKISIRGNRIIWTLIDINGKTKSVFFEYNIREDIS<br>EYINRWFFVTITNNLNNAKIYINGKLESNTDIKDIREVIANGEIIFKLDGDIDRTQFI<br>WMKYFSIFNTELSQSNIEERYKIQSYSEYLKDFWGNPLMYNKEYYMFNAGNKNS<br>YIKLKKDSPVGEILTRSKYNQNSKYINYRDLYIGEKFIIRRKSNSQSINDDIVRKED<br>YIYLDFFNLNQEWRVYTYKYFKKEEEKLFLAPISDSDEFYNTIQIKEYDEQPTYSC<br>QLLFKKDEESTDEIGLIGIHRFYESGIVFEEYKDYFCISKWYLKEVKRKPYNLKLG<br>CNWQFIPKDEGWTE |
| 19 | Chimeric toxin BoNT/A3 (1-872)-B1 (860-1291) | MPFVNKPFNYRDPGNGVDIAYIKIPNAGQMQPVKAFKIHEGVWVIPERDTFTNPE<br>EGDLNPPPEAKQVPVSYYDSTYLSTDNEKDNYLKGVIKLFDRIYSTGLGRMLLSFI<br>VKGIPFWGGSTIDTELKVIDTNCINVIEPGGSYRSEELNLVITGPSADIIQFECKSFG<br>HDVFNLTRNGYGSTQYIRFSPDFTFGFEESLEVDTNPLLGAGTFATDPAVTLAHEL<br>IHAAHRLYGIAINPNRVLKVKTNAYYEMSGLEVSFEELRTFGGNDTNFIDSLWQK<br>KFSRDAYDNLQNIARILNEAKTIVGTTTPLQYMKNIFIRKYFLSEDASGKISVNKA<br>AFKEFYRVLTRGFTELEFVNPFKVINRKTYLNFDKAVFRINIVPDENYTINEGFNLE<br>GANSNGQNTEINSRNFTRLKNFTGLFEFYKLLCVRGIIPFKTKSLDEGYNKALNYL<br>CIKVNNWDLFFSPSEDNFTNDLDKVEEITADTNIEAAEENISSDLIQQYYLTFDFDN<br>EPENISIENLSSDIIGQLEPMPNIERFPNGKKYELDKYTMFHYLRAQEFEHGDSRIIL<br>TNSAEEALLKPNVAYTFFSSKYVKKINKAVEAVIFLSWAEELVYDFTDETNEVTT<br>MDKIADITIIVPYIGPALNIGNMVSKGEFVEAILFTGVVALLEFIPEYSLPVFGTFAI<br>VSYIANKVLTVQTINNALSKRNEKWDEVYKYTVTNWLAKVNTQIDLIREKMKK<br>ALENQAEATRAIINYQYNQYTEEEKNNINFNIDDLSSKLNRSINRAMININKFLDQ<br>CSVSYLMNSMIPYAVKRLKDFDASVRDVLLKYIYDNRGTLILQVDRLKDEVNNT<br>LSADIPFQLSKYVNDKKLLSTFTEYIKNIVNTILNNIILNLRYKDNNLIDLSGYGAK<br>VEVYDGVELNDKNQFKLTSSANSKIRVTQNQNIIFNSVFLDFSVSFWIRIPKYKND<br>GIQNYIHNEYTIINCMKNNSGWKISIRGNRIIWTLIDINGKTKSVFFEYNIREDISEYI<br>NRWFFVTITNNLNNAKIYINGKLESNTDIKDIREVIANGEIIFKLDGDIDRTQFIWM<br>KYFSIFNTELSQSNIEERYKIQSYSEYLKDFWGNPLMYNKEYYMFNAGNKNSYIK<br>LKKDSPVGEILTRSKYNQNSKYINYRDLYIGEKFIIRRKSNSQSINDDIVRKEDYIY<br>LDFFNLNQEWRVYTYKYFKKEEEKLFLAPISDSDEFYNTIQIKEYDEQPTYSCQLL<br>FKKDEESTDEIGLIGIHRFYESGIVFEEYKDYFCISKWYLKEVKRKPYNLKLGCNW<br>QFIPKDEGWTE |
| 20 | Chimeric toxin BoNT/A4 (1-872)-B1 (860-1291) | MPLVNQQINYYDPVNGVDIAYIKIPNAGKMQPVKAFKIHNKVWVIPERDIFTNPE<br>EVDLNPPPEAKQVPISYYDSAYLSTDNEKDNYLKGVIKLFERIYSTDLGRMLLISIV<br>RGIPFWGGGKIDTELKVIDTNCINIIQLDDSYRSEELNLAIIGPSANIIESQCSSFRDD<br>VLNLTRNGYGSTQYIRFSPDFTVGFEESLEVDTNPLLGAGKFAQDPAVALAHELI<br>HAEHRLYGIAINTNRVFKVNTNAYYEMAGLEVSLEELITFGGNDAKFIDSLQKKE<br>FSLYYYNKFKDIASTLNKAKSIVGTTASLQYMKNVFKEKYLLSEDATGKFLVDRL<br>KFDELYKLLTEIYTEDNFVKFFKVLNRKTYLNFDKAVFKINIVPDVNYTIHDGFNL<br>RNTNLAANFNGQNIEINNKNFDKLKNFTGLFEFYKLLCVRGIITSKTKSLDEGYNK<br>ALNELCIKVNNWDLFFSPSEDNFTNDLDKVEEITSDTNIEAAEENISLDLIQQYYLN<br>FNFDNEPENTSIENLSSDIIGQLEPMPNIERFPNGKKYELNKYTMFHYLRAQEFKH<br>SNSRIILTNSAKEALLKPNIVYTFFSSKYIKAINKAVEAVTFVNWIENLVYDFTDET<br>NEVSTMDKIADITIVIPYIGPALNIGNMIYKGEFVEAIIFSGAVILLEIVPEIALPVLG<br>TFALVSYVSNKVLTVQTIDNALSKRNEKWDEVYKYIVTNWLAIVNTQINLIREKM<br>KKALENQAEATKAIINYQYNQYTEEEKNNINFNIDDLSSKLNESINSAMININKFL<br>DQCSVSYLMNSMIPYAVKRLKDFDASVRDVLLKYIYDNRGTLIGQVNRLKDKVN<br>NTLSADIPFQLSKYVDNKKLLSTFTEYIKNILNNIILNLRYKDNNLIDLSGYGAKVE<br>VYDGVELNDKNQFKLTSSANSKIRVTQNQNIIFNSVFLDFSVSFWIRIPKYKNDGI<br>QNYIHNEYTIINCMKNNSGWKISIRGNRIIWTLIDINGKTKSVFFEYNIREDISEYIN<br>RWFFVTITNNLNNAKIYINGKLESNTDIKDIREVIANGEIIFKLDGDIDRTQFIWMK<br>YFSIFNTELSQSNIEERYKIQSYSEYLKDFWGNPLMYNKEYYMFNAGNKNSYIKL<br>KKDSPVGEILTRSKYNQNSKYINYRDLYIGEKFIIRRKSNSQSINDDIVRKEDYIYL<br>DFFNLNQEWRVYTYKYFKKEEEKLFLAPISDSDEFYNTIQIKEYDEQPTYSCQLLF<br>KKDEESTDEIGLIGIHRFYESGIVFEEYKDYFCISKWYLKEVKRKPYNLKLGCNW<br>QFIPKDEGWTE |
| 21 | Chimeric toxin BoNT/A5 (1-872)-B1 (860-1291) | MLFVNKQFNYKDPVNGVDIAYIKIPNAGQMQPVKAFKIHNKIWVIPERDTFTNPE<br>EGDLNPPPEAKQVPVSYYDSTYLSTDNEKDNYLKGVTKLFERIYSTELGRMLLTSI<br>VRGIPFWGGSTIDTELKVIDTNCINVIQPDGSYRSEELNLVIIGPSADIIQPECKSFGH<br>DVLNLTRNGYGSTQYIRFSPDFTFGFEESLEVDTNPLLGAGKFATDPAVTLAHELI<br>HAGHRLYGIAINPNRVFKVNTNAYYEMSGLEVSFEELRTFGEHDAKFIDSLQENE<br>FRLYYYNKFKDIASTLNKAKSIVGTTASLQYMKNVFKEKYLLSEDTSGKFSVDKL |

TABLE 1-continued

Exemplary, non-limiting BoNT amino acid sequences

| SEQ ID NO | Description | Sequence |
|---|---|---|
| | | KFDKLYKMLTEIYTEDNFVKFFKVLNRKTYLNFDKAVFKINIVPEVNYTIYDGFN<br>LRNTNLAANFNGQNTEINNMNFTKLKNFTGLFEFYKLLCVRGIITSKTKSLDEGY<br>NKALNDLCIKVNNWDLFFSPSEDNFTNDLNKGEEITSDTNIEAAEENISLDLIQQY<br>YLTFNFDNEPENISIENLSSDIIGQLELMPNIERFPNGKKYELDKYTMFHYLRAQEF<br>EHGKSRIVLTNSVNEALLNPSSVYTFFSSDYVRKVNKATEAAMFLGWVEQLVYD<br>FTDETSEVSTTDKIADITIIIPYIGPALNIGNMLYKDDFVGALIFSGAVILLEFIPEIAIP<br>VLGTFALVSYIANKVLTVQTIDNALSKRNEKWGEVYKYIVTNWLAKVNTQIDLIR<br>KKMKEALENQAEATKAIINYQYNQYTEEEKNNINFNIGDLSSKLNDSINKAMININ<br>KFLNQCSVSYLMNSMIPYGVKRLEDFDASLKDALLKYIYDNRGTLIGQVDRLKD<br>KVNNTLSTDIPFQLSKYVDNQRLLSTFTEYIKNILNNIILNLRYKDNNLIDLSGYGA<br>KVEVYDGVELNDKNQFKLTSSANSKIRVTQNQNIIFNSVFLDFSVSFWIRIPKYKN<br>DGIQNYIHNEYTIINCMKNNSGWKISIRGNRIIWTLIDINGKTKSVFFEYNIREDISE<br>YINRWFFVTITNNLNNAKIYINGKLESNTDIKDIREVIANGEIIFKLDGDIDRTQFIW<br>MKYFSIFNTELSQSNIEERYKIQSYSEYLKDFWGNPLMYNKEYYMFNAGNKNSYI<br>KLKKDSPVGEILTRSKYNQNSKYINYRDLYIGEKFIIRRKSNSQSINDDIVRKEDYI<br>YLDFFNLNQEWRVYTYKYFKKEEEKLFLAPISDSDEFYNTIQIKEYDEQPTYSCQL<br>LFKKDEESTDEIGLIGIHRFYESGIVFEEYKDYFCISKWYLKEVKRKPYNLKLGCN<br>WQFIPKDEGWTE |
| 22 | Chimeric toxin BoNT/A6 (1-872)-B1 (860-1291) | MPFVNKQFNYKDPVNGVDIAYIKIPNAGQMQPVKAFKIHNKIWVIPERDTFTNPE<br>EGDLNPPPEAKQVPVSYYDSTYLSTDNEKDNYLKGVTKLFERIYSTDLGRMLLTS<br>IVRGIPFWGGSTIDTELKVIDTNCINVIQPDGSYRSEELNLVIIGPSADIIQFECKSFG<br>HEVLNLTRNGYGSTQYIRFSPDFTFGFEESLEVDTNPLLGAGKFATDPAVTLAHEL<br>IHAGHRLYGIAINPNRVFKVNTNAYYEMSGLEVSFEELRTFGGHDAKFIDSLQEN<br>EFRLYYYNKFKDIASTLNKAKSIVGTTASLQYMKNVFKEKYLLSEDTSGKFSVDK<br>LKFDKLYKMLTEIYTEDNFVKFFKVLNRKTYLNFDKAVFKINIVPKVNYTIYDGF<br>NLRNTNLAANFNGQNTEINNMNFAKLKNFTGLFEFYKLLCVRGIITSKTKSLDKG<br>YNKALNDLCIKVNNWDLFFSPSEDNFTNDLNKGEEITSDTNIEAAEENISLDLIQQ<br>YYLTFNFDNEPENISIENLSSDIIGQLELMPNIERFPNGKKYELDKYTMFHYLSAQE<br>FEHGKSRIDLTNSVNEALLNPSHVYTFFSSDYVKKVNKATEAAMFLGWVEQLVY<br>DFTDETSEVSTTDKIADITIIIPYIGPALNIGNMLYKDDFVGALIFSGAVILLEFIPEIA<br>IPVLGTFAIVSYIANKVLTVQTINNALSKRNEKWDEVYKYTVTNWLAKVNTQIDL<br>IREKMKKALENQAEATKAIINYQYNQYTEEEKNNINFNIDDLSSKLNESINSAMINI<br>NKFLDQCSVSYLMNSMIPYAVKRLKDFDASVRDVLLKYIYDNRGTLIGQVDRLK<br>DKVNNTLSTDIPFQLSKYVDNQRLLSTFTEYIKNILNNIILNLRYKDNNLIDLSGYG<br>AKVEVYDGVELNDKNQFKLTSSANSKIRVTQNQNIIFNSVFLDFSVSFWIRIPKYK<br>NDGIQNYIHNEYTIINCMKNNSGWKISIRGNRIIWTLIDINGKTKSVFFEYNIREDIS<br>EYINRWFFVTITNNLNNAKIYINGKLESNTDIKDIREVIANGEIIFKLDGDIDRTQFI<br>WMKYFSIFNTELSQSNIEERYKIQSYSEYLKDFWGNPLMYNKEYYMFNAGNKNS<br>YIKLKKDSPVGEILTRSKYNQNSKYINYRDLYIGEKFIIRRKSNSQSINDDIVRKED<br>YIYLDFFNLNQEWRVYTYKYFKKEEEKLFLAPISDSDEFYNTIQIKEYDEQPTYSC<br>QLLFKKDEESTDEIGLIGIHRFYESGIVFEEYKDYFCISKWYLKEVKRKPYNLKLG<br>CNWQFIPKDEGWTE |
| 23 | Chimeric toxin BoNT/A7 (1-872)-B1 (860-1291) | MPFVNKQFNYKDPVNGVDIAYIKIPNAGQMQPVKAFKIHNKIWVIPERDIFTNPEE<br>GDLNPPPEAKQVPVSYYDSTYLSTDNEKDNYLKGVTKLFERIYSTDLGRMLLTSI<br>VRGIPFWGGSTIDTELKVIDTNCINVIQPDGSYRSEELNLVIIGPSADIINFECKSFGH<br>DVLNLTRNGYGSTQYIRFSPDFTFGFEESLEVDTNPLLGAGKFAIDPAVTLAHELI<br>HAGHRLYGIAINPNRVFKVNTNAYYEMSGLEVSFEELRTFGGHDAKFIDSLQENE<br>FRLYYYNKFKEVASILNKAKSIIGTTASLQYMKNVFKEKYLLSEDTSGKFSVDKL<br>RFDKLYKMLTEIYTEDNFVKFFKVLNRKTYLNFDKAVFKMNIVPEVNYTIYDGF<br>NLRNTNLAANFNGQNTEINNMNFTKLKNFTGLFEFYKLLCVRGIITSKTKSLDEG<br>YNKALNDLCIKVNNWDLFFSPSEDNFTNDLNKGEEITSDTNIEAAEENISSDLIQQ<br>YYLTFNFDNEPENISIENLSSDIIGQLELMPNIERFPNGKKYELDKYTMFHYLRAQE<br>FEYGNSRIVLINSVNEALLNPSSVYTFFSSDYVKKANEATEAAMFLGWVEQLVYD<br>FTDETSEVSTMDKIADITIIVPYIGPALNIGNMVYKKKFEEALIFSGAVILLEFVPEI<br>VLPILGTFALVSYTSNKVLTVRTIDNALSKRNEKWEEVYKYIVTNWLAKVNTQIN<br>LIRKKMKEALENQAEATKAIINYQYNQYTEEEKNNINFNIGDLSSKLNDSINKAMI<br>NINKFLDQCSVSYLMNSMIPQGVKQLKDFDTSLRDSLLKYIYDNRGTLIGQVDRL<br>KDKVNNTLSTDIPFQLSKYADNQRLLSTFTEYIKNILNNIILNLRYKDNNLIDLSGY<br>GAKVEVYDGVELNDKNQFKLTSSANSKIRVTQNQNIIFNSVFLDFSVSFWIRIPKY<br>KNDGIQNYIHNEYTIINCMKNNSGWKISIRGNRIIWTLIDINGKTKSVFFEYNIREDI<br>SEYINRWFFVTITNNLNNAKIYINGKLESNTDIKDIREVIANGEIIFKLDGDIDRTQFI<br>WMKYFSIFNTELSQSNIEERYKIQSYSEYLKDFWGNPLMYNKEYYMFNAGNKNS<br>YIKLKKDSPVGEILTRSKYNQNSKYINYRDLYIGEKFIIRRKSNSQSINDDIVRKED<br>YIYLDFFNLNQEWRVYTYKYFKKEEEKLFLAPISDSDEFYNTIQIKEYDEQPTYSC<br>QLLFKKDEESTDEIGLIGIHRFYESGIVFEEYKDYFCISKWYLKEVKRKPYNLKLG<br>CNWQFIPKDEGWTE |
| 24 | Chimeric toxin BoNT/A8 (1-872)-B1 (860-1292) | MPFVNKQFNYKDTVNGIDIAYIKIPNAGQMQPVKAFKIHNKIWVIPERDTFTNPKE<br>GDLNPPPEAKQVPVSYYDSTYLSTDNEKDNYLKGVTKLFERIYSTDLGRMLLTSI<br>VRGIPFWGGSTIDTELKVIDTNCINVIQPDGSYRSEELNLVIIGPSADIIQPECKSFGH<br>DVLNLTRNGYGSTQYIRFSPDFTFGFEESLEVDTNPLLGAGKFATDPAVTLAHELI<br>HAEHRLYGIAINPNRVFKVNTNAYYEMSGLEVSFEELRTFGGHNAKFIDSLQENE |

TABLE 1-continued

Exemplary, non-limiting BoNT amino acid sequences

| SEQ ID NO | Description | Sequence |
|---|---|---|
| | | FRLYYYNKFKDIASTLNKAKSIVGTTASLQYMKNVFKEKYLLSEDTSGKFSVDKL<br>KFDKLYKMLTEIYTEDNFVKFFKVLNRKTYLNFDKAVFKINIVPDENYTIKDGFN<br>LKNTNLAANFNGQNTEINSRNFTKLKNFTGLFEFYKLLCVRGIIPFKTKSLDEGYN<br>KALNDLCIKVNNWDLFFSPSEDNFTNDLDKVEEITSDTNIEAAEENISLDLIQQYY<br>LTFDFDNEPENISIENLSSDIIGQLEPMPNIERFPNGKKYELDKYTMFHYLRAQEFE<br>HSKSRIALTNSVNEALLNPSRVYTFFSSDYVKKVNKATEAAMFLGWVEQLVYDF<br>TDETSEVSTTDKIADITIIIPYIGPALNIGNMLYKDDFVGALIFSGAVILLEFIPEIAIP<br>VLGTFALVSYIANKVLTVQTIDNALSKRNEKWDEVYKYIVTNWLAKVNTQIDLV<br>RKKMKEALENQAEATKAIINYQYNQYTEEEKNNINFNIDDLSSKLNESINSAMTNI<br>NKFLDQCSVSYLMNSMIPYAVKRLKDFDASVREVLLKYIYDNRGTLILQVDRLK<br>DKVNNTLSADIPFQLSKYVDNKKLLSTFTEYIKNILNNIILNLRYKDNNLIDLSGYG<br>AKVEVYDGVELNDKNQFKLTSSANSKIRVTQNQNIIFNSVFLDFSVSFWIRIPKYK<br>NDGIQNYIHNEYTIINCMKNNSGWKISIRGNRIIWTLIDINGKTKSVFFEYNIREDIS<br>EYINRWFFVTITNNLNNAKIYINGKLESNTDIKDIREVIANGEIIFKLDGDIDRTQFI<br>WMKYFSIFNTELSQSNIEERYKIQSYSEYLKDFWGNPLMYNKEYYMFNAGNKNS<br>YIKLKKDSPVGEILTRSKYNQNSKYINYRDLYIGEKFIIRRKSNSQSINDDIVRKED<br>YIYLDFFNLNQEWRVYTYKYFKKEEEKLFLAPISDSDEFYNTIQIKEYDEQPTYSC<br>QLLFKKDEESTDEIGLIGIHRFYESGIVFEEYKDYFCISKWYLKEVKRKPYNLKLG<br>CNWQFIPKDEGWTE |
| 25 | BoNT/B1<br>I1228W/V1249W | MPVTINNFNYNDPIDNNNIIMMEPPFARGTGRYYKAFKITDRIWIIPERYTFGYKPE<br>DFNKSSGIFNRDVCEYYDPDYLNTNDKKNIFLQTMIKLFNRIKSKPLGEKLLEMII<br>NGIPYLGDRRVPLEEFNTNIASVTVNKLISNPGEVERKKGIFANLIIFGPGPVLNEN<br>ETIDIGIQNHFASREGFGGIMQMKFCPEYVSVFNNVQENKGASIFNRRGYFSDPAL<br>ILMHELIHVLHGLYGIKVDDLPIVPNEKKFFMQSTDAIQAEELYTFGGQDPSIITPS<br>TDKSIYDKVLQNFRGIVDRLNKVLVCISDPNININIYKNKFKDKYKFVEDSEGKYS<br>IDVESFDKLYKSLMFGFTETNIAENYKIKTRASYFSDSLPPVKIKNLLDNEIYTIEEG<br>FNISDKDMEKEYRGQNKAINKQAYEEISKEHLAVYKIQMCKSVKAPGICIDVDNE<br>DLFFIADKNSFSDDLSKNERIEYNTQSNYIENDFPINELILDTDLISKIELPSENTESL<br>TDFNVDVPVYEKQPAIKKIFTDENTIFQYLYSQTFPLDIRDISLTSSFDDALLFSNK<br>VYSFFSMDYIKTANKVVEAGLFAGWVKQIVNDFVIEANKSNTMDKIADISLIVPYI<br>GLALNVGNETAKGNFENAFEIAGASILLEFIPELLIPVVGAFLLESYIDNKNKIIKTI<br>DNALTKRNEKWSDMYGLIVAQWLSTVNTQFYTIKEGMYKALNYQAQALEEIIK<br>YRYNIYSEKEKSNINIDFNDINSKLNEGINQAIDNINNFINGCSVSYLMKKMIPLAV<br>EKLLDFDNTLKKNLLNYIDENKLYLIGSAEYEKSKVNKYLKTIMPFDLSIYTNDTI<br>LIEMFNKYNSEILNNIILNLRYKDNNLIDLSGYGAKVEVYDGVELNDKNQFKLTSS<br>ANSKIRVTQNQNIIFNSVFLDFSVSFWIRIPKYKNDGIQNYIHNEYTIINCMKNNSG<br>WKISIRGNRIIWTLIDINGKTKSVFFEYNIREDISEYINRWFFVTITNNLNNAKIYIN<br>GKLESNTDIKDIREVIANGEIIFKLDGDIDRTQFIWMKYFSIFNTELSQSNIEERYKI<br>QSYSEYLKDFWGNPLMYNKEYYMFNAGNKNSYIKLKKDSPVGEILTRSKYNQNS<br>KYINYRDLYIGEKFIIRRKSNSQSINDDIVRKEDYIYLDFFNLNQEWRVYTYKYFK<br>KEEEKLFLAPISDSDEFYNTIQIKEYDEQPTYSCQLLFKKDEESTDEIGLIGIHRFYE<br>SGWWFEEYKDYFCISKWYLKEVKRKPYNLKLGCNWQFIPKDEGWTE |
| 26 | Receptor<br>binding<br>domain of<br>BoNT/B1<br>I389W/V390W | ILNNIILNLRYKDNNLIDLSGYGAKVEVYDGVELNDKNQFKLTSSANSKIRVTQN<br>QNIIFNSVFLDFSVSFWIRIPKYKNDGIQNYIHNEYTIINCMKNNSGWKISIRGNRII<br>WTLIDINGKTKSVFFEYNIREDISEYINRWFFVTITNNLNNAKIYINGKLESNTDIK<br>DIREVIANGEIIFKLDGDIDRTQFIWMKYFSIFNTELSQSNIEERYKIQSYSEYLKDF<br>WGNPLMYNKEYYMFNAGNKNSYIKLKKDSPVGEILTRSKYNQNSKYINYRDLYI<br>GEKFIIRRKSNSQSINDDIVRKEDYIYLDFFNLNQEWRVYTYKYFKKEEEKLFLAPI<br>SDSDEFYNTIQIKEYDEQPTYSCQLLFKKDEESTDEIGLIGIHRFYESGWWPEEYK<br>DYFCISKWYLKEVKRKPYNLKLGCNWQFIPKDEGWTE |
| 27 | Chimeric<br>toxin<br>BoNT/A1-<br>B1<br>I1262W/V1<br>262W | MPFVNKQFNYKDPVNGVDIAYIKIPNAGQMQPVKAFKIHNKIWVIPERDTFTNPE<br>EGDLNPPPEAKQVPVSYYDSTYLSTDNEKDNYLKGVTKLFERIYSTDLGRMLLTS<br>IVRGIPFWGGSTIDTELKVIDTNCINVIQPDGSYRSEELNLVIIGPSADIIQFECKSFG<br>HEVLNLTRNGYGSTQYIRFSPDFTFGFEESLEVDTNPLLGAGKFATDPAVTLAHEL<br>IHAGHRLYGIAINPNRVFKVNTNAYYEMSGLEVSFEELRTFGGHDAKFIDSLQEN<br>EFRLYYYNKFKDIASTLNKAKSIVGTTASLQYMKNVFKEKYLLSEDTSGKFSVDK<br>LKFDKLYKMLTEIYTEDNFVKFFKVLNRKTYLNFDKAVFKINIVPKVNYTIYDGF<br>NLRNTNLAANFNGQNTEINNMNFTKLKNFTGLFEFYKLLCVRGIITSKTKSLDKG<br>YNKALNDLCIKVNNWDLFFSPSEDNFTNDLNKGEEITSDTNIEAAEENISLDLIQQ<br>YYLTFNFDNEPENISIENLSSDIIGQLELMPNIERFPNGKKYELDKYTMFHYLRAQE<br>FEHGKSRIALTNSVNEALLNPSRVYTFFSSDYVKKVNKATEAAMFLGWVEQLVY<br>DFTDETSEVSTTDKIADITIIIPYIGPALNIGNMLYKDDFVGALIFSGAVILLEFIPEIA<br>IPVLGTFALVSYIANKVLTVQTIDNALSKRNEKWDEVYKYIVTNWLAKVNTQIDL<br>IRKKMKEALENQAEATKAIINYQYNQYTEEEKNNINFNIDDLSSKLNESINKAMIN<br>INKFLNQCSVSYLMNSMIPYGVKRLEDFDASLKDALLKYIYDNRGTLIGQVDRLK<br>DKVNNTLSTDIPFQLSKYVDNQRLLSTFTEYIKNILNNIILNLRYKDNNLIDLSGYG<br>AKVEVYDGVELNDKNQFKLTSSANSKIRVTQNQNIIFNSVFLDFSVSFWIRIPKYK<br>NDGIQNYIHNEYTIINCMKNNSGWKISIRGNRIIWTLIDINGKTKSVFFEYNIREDIS<br>EYINRWFFVTITNNLNNAKIYINGKLESNTDIKDIREVIANGEIIFKLDGDIDRTQFI<br>WMKYFSIFNTELSQSNIEERYKIQSYSEYLKDFWGNPLMYNKEYYMFNAGNKNS<br>YIKLKKDSPVGEILTRSKYNQNSKYINYRDLYIGEKFIIRRKSNSQSINDDIVRKED |

TABLE 1-continued

Exemplary, non-limiting BoNT amino acid sequences

| SEQ ID NO | Description | Sequence |
|---|---|---|
| | | YIYLDFFNLNQEWRVYTYKYFKKEEEKLFLAPISDSDEFYNTIQIKEYDEQPTYSC<br>QLLFKKDEESTDEIGLIGIHRFYESGWWFEEYKDYFCISKWYLKEVKRKPYNLKL<br>GCNWQFIPKDEGWTE |
| 28 | Chimeric toxin BoNT/A2-B1 I1262W/V1262W | MPFVNKQFNYKDPVNGVDIAYIKIPNAGQMQPVKAFKIHNKIWVIPERDTFTNPE<br>EGDLNPPPEAKQVPVSYYDSTYLSTDNEKDNYLKGVTKLFERIYSTDLGRMLLTS<br>IVRGIPFWGGSTIDTELKVIDTNCINVIQPDGSYRSEELNLVIIGPSADIIQFECKSFG<br>HDVLNLTRNGYGSTQYIRFSPDFTFGFEESLEVDTNPLLGAGKFATDPAVTLAHE<br>LIHAEHRLYGIAINPNRVFKVNTNAYYEMSGLEVSFEELRTFGGHDAKFIDSLQEN<br>EFRLYYYNKFKDVASTLNKAKSIIGTTASLQYMKNVFKEKYLLSEDTSGKFSVDK<br>LKFDKLYKMLTEIYTEDNFVNFFKVINRKTYLNFDKAVFRINIVPDENYTIKDGFN<br>LKGANLSTNFNGQNTEINSRNFTRLKNFTGLFEFYKLLCVRGIIPFKTKSLDEGYN<br>KALNDLCIKVNNWDLFFSPSEDNFTNDLDKVEEITADTNIEAAEENISLDLIQQYY<br>LTFDFDNEPENISIENLSSDIIGQLEPMPNIERFPNGKKYELDKYTMFHYLRAQEFE<br>HGDSRIILTNSAEEALLKPNVAYTFFSSKYVKKINKAVEAFMFLNWAEELVYDFT<br>DETNEVTTMDKIADITIIVPYIGPALNIGNMLSKGEFVEAIIFTGVVAMLEFIPEYAL<br>PVFGTFAIVSYIANKVLTVQTINNALSKRNEKWDEVYKYTVTNWLAKVNTQIDLI<br>REKMKKALENQAEATKAIINYQYNQYTEEEKNNINFNIDDLSSKLNESINSAMINI<br>NKFLDQCSVSYLMNSMIPYAVKRLKDFDASVRDVLLKYIYDNRGTLVLQVDRLK<br>DEVNNTLSADIPFQLSKYVDNKKLLSTFTEYIKNILNNIILNLRYKDNNLIDLSGYG<br>AKVEVYDGVELNDKNQFKLTSSANSKIRVTQNQNIIFNSVFLDFSVSFWIRIPKYK<br>NDGIQNYIHNEYTIINCMKNNSGWKISIRGNRIIWTLIDINGKTKSVFFEYNIREDIS<br>EYINRWFFVTITNNLNNAKIYINGKLESNTDIKDIREVIANGEIIFKLDGDIDRTQFI<br>WMKYFSIFNTELSQSNIEERYKIQSYSEYLKDFWGNPLMYNKEYYMFNAGNKNS<br>YIKLKKDSPVGEILTRSKYNQNSKYINYRDLYIGEKFIIRRKSNSQSINDDIVRKED<br>YIYLDFFNLNQEWRVYTYKYFKKEEEKLFLAPISDSDEFYNTIQIKEYDEQPTYSC<br>QLLFKKDEESTDEIGLIGIHRFYESGWWFEEYKDYFCISKWYLKEVKRKPYNLKL<br>GCNWQFIPKDEGWTE |
| 29 | BoNT/A1 fragment (1-872) | MPFVNKQFNYKDPVNGVDIAYIKIPNAGQMQPVKAFKIHNKIWVIPERDTFTNPE<br>EGDLNPPPEAKQVPVSYYDSTYLSTDNEKDNYLKGVTKLFERIYSTDLGRMLLTS<br>IVRGIPFWGGSTIDTELKVIDTNCINVIQPDGSYRSEELNLVIIGPSADIIQFECKSFG<br>HEVLNLTRNGYGSTQYIRFSPDFTFGFEESLEVDTNPLLGAGKFATDPAVTLAHEL<br>IHAGHRLYGIAINPNRVFKVNTNAYYEMSGLEVSFEELRTFGGHDAKFIDSLQEN<br>EFRLYYYNKFKDIASTLNKAKSIVGTTASLQYMKNVFKEKYLLSEDTSGKFSVDK<br>LKFDKLYKMLTEIYTEDNFVKFFKVLNRKTYLNFDKAVFKINIVPKVNYTIYDGF<br>NLRNTNLAANFNGQNTEINNMNFTKLKNFTGLFEFYKLLCVRGIITSKTKSLDKG<br>YNKALNDLCIKVNNWDLFFSPSEDNFTNDLNKGEEITSDTNIEAAEENISLDLIQQ<br>YYLTFNFDNEPENISIENLSSDIIGQLELMPNIERFPNGKKYELDKYTMFHYLRAQE<br>FEHGKSRIALTNSVNEALLNPSRVYTFFSSDYVKKVNKATEAAMFLGWVEQLVY<br>DFTDETSEVSTTDKIADITIIIPYIGPALNIGNMLYKDDFVGALIFSGAVILLEFIPEIA<br>IPVLGTFALVSYIANKVLTVQTIDNALSKRNEKWDEVYKYIVTNWLAKVNTQIDL<br>IRKKMKEALENQAEATKAIINYQYNQYTEEEKNNINFNIDDLSSKLNESINKAMIN<br>INKFLNQCSVSYLMNSMIPYGVKRLEDFDASLKDALLKYIYDNRGTLIGQVDRLK<br>DKVNNTLSTDIPFQLSKYVDNQRLLSTFTEYIKN |
| 30 | BoNT/A2 fragment (1-872) | MPFVNKQFNYKDPVNGVDIAYIKIPNAGQMQPVKAFKIHNKIWVIPERDTFTNPE<br>EGDLNPPPEAKQVPVSYYDSTYLSTDNEKDNYLKGVTKLFERIYSTDLGRMLLTS<br>IVRGIPFWGGSTIDTELKVIDTNCINVIQPDGSYRSEELNLVIIGPSADIIQFECKSFG<br>HDVLNLTRNGYGSTQYIRFSPDFTFGFEESLEVDTNPLLGAGKFATDPAVTLAHE<br>LIHAEHRLYGIAINPNRVFKVNTNAYYEMSGLEVSFEELRTFGGHDAKFIDSLQEN<br>EFRLYYYNKFKDVASTLNKAKSIIGTTASLQYMKNVFKEKYLLSEDTSGKFSVDK<br>LKFDKLYKMLTEIYTEDNFVNFFKVINRKTYLNFDKAVFRINIVPDENYTIKDGFN<br>LKGANLSTNFNGQNTEINSRNFTRLKNFTGLFEFYKLLCVRGIIPFKTKSLDEGYN<br>KALNDLCIKVNNWDLFFSPSEDNFTNDLDKVEEITADTNIEAAEENISLDLIQQYY<br>LTFDFDNEPENISIENLSSDIIGQLEPMPNIERFPNGKKYELDKYTMFHYLRAQEFE<br>HGDSRIILTNSAEEALLKPNVAYTFFSSKYVKKINKAVEAFMFLNWAEELVYDFT<br>DETNEVTTMDKIADITIIVPYIGPALNIGNMLSKGEFVEAIIFTGVVAMLEFIPEYAL<br>PVFGTFAIVSYIANKVLTVQTINNALSKRNEKWDEVYKYTVTNWLAKVNTQIDLI<br>REKMKKALENQAEATKAIINYQYNQYTEEEKNNINFNIDDLSSKLNESINSAMINI<br>NKFLDQCSVSYLMNSMIPYAVKRLKDFDASVRDVLLKYIYDNRGTLVLQVDRLK<br>DEVNNTLSADIPFQLSKYVDNKKLLSTFTEYIKN |
| 31 | BoNT/A3 fragment (1-872) | MPFVNKPFNYRDPGNGVDIAYIKIPNAGQMQPVKAFKIHEGVWVIPERDTFTNPE<br>EGDLNPPPEAKQVPVSYYDSTYLSTDNEKDNYLKGVIKLFDRIYSTGLGRMLLSFI<br>VKGIPFWGGSTIDTELKVIDTNCINVIEPGGSYRSEELNLVITGPSADIIQFECKSFG<br>HDVFNLTRNGYGSTQYIRFSPDFTFGFEESLEVDTNPLLGAGTFATDPAVTLAHEL<br>IHAAHRLYGIAINPNRVLKVKTNAYYEMSGLEVSFEELRTFGGNDTNFIDSLWQK<br>KFSRDAYDNLQNIARILNEAKTIVGTTTPLQYMKNIFIRKYFLSEDASGKISVNKA<br>AFKEFYRVLTRGFTELEFVNPFKVINRKTYLNFDKAVFRINIVPDENYTINEGFNLE<br>GANSNGQNTEINSRNFTRLKNFTGLFEFYKLLCVRGIIPFKTKSLDEGYNKALNYL<br>CIKVNNWDLFFSPSEDNFTNDLDKVEEITADTNIEAAEENISSDLIQQYYLTFDFDN<br>EPENISIENLSSDIIGQLEPMPNIERFPNGKKYELDKYTMFHYLRAQEFEHGDSRIIL<br>TNSAEEALLKPNVAYTFFSSKYVKKINKAVEAVIFLSWAEELVYDFTDETNEVTT |

TABLE 1-continued

| SEQ ID NO | Description | Sequence |
|---|---|---|
| | | MDKIADITIIVPYIGPALNIGNMVSKGEFVEAILFTGVVALLEFIPEYSLPVFGTFAI VSYIANKVLTVQTINNALSKRNEKWDEVYKYTVTNWLAKVNTQIDLIREKMKK ALENQAEATRAIINYQYNQYTEEEKNNINFNIDDLSSKLNRSINRAMININKFLDQ CSVSYLMNSMIPYAVKRLKDFDASVRDVLLKYIYDNRGTLILQVDRLKDEVNNT LSADIPFQLSKYVNDKKLLSTFTEYIKNIVNT |
| 32 | BoNT/A4 fragment (1-872) | MPLVNQQINYYDPVNGVDIAYIKIPNAGKMQPVKAFKIHNKVWVIPERDIFTNPE EVDLNPPPEAKQVPISYYDSAYLSTDNEKDNYLKGVIKLFERIYSTDLGRMLLISIV RGIPFWGGGKIDTELKVIDTNCINIIQLDDSYRSEELNLAIIGPSANIIESQCSSFRDD VLNLTRNGYGSTQYIRFSPDFTVGFEESLEVDTNPLLGAGKFAQDPAVALAHELI HAEHRLYGIAINTNRVFKVNTNAYYEMAGLEVSLEELITFGGNDAKFIDSLQKKE FSLYYYNKFKDIASTLNKAKSIVGTTASLQYMKNVFKEKYLLSEDATGKFLVDRL KFDELYKLLTEIYTEDNFVKFFKVLNRKTYLNFDKAVFKINIVPDVNYTIHDGFNL RNTNLAANFNGQNIEINNKNFDKLKNFTGLFEFYKLLCVRGIITSKTKSLDEGYNK ALNELCIKVNNWDLFFSPSEDNFTNDLDKVEEITSDTNIEAAEENISLDLIQQYYLN FNFDNEPENTSIENLSSDIIGQLEPMPNIERFPNGKKYELNKYTMFHYLRAQEFKH SNSRIILTNSAKEALLKPNIVYTFFSSKYIKAINKAVEAVTFVNWIENLVYDFTDET NEVSTMDKIADITIVIPYIGPALNIGNMIYKGEFVEAIIFSGAVILLEIVPEIALPVLG TFALVSYVSNKVLTVQTIDNALSKRNEKWDEVYKYIVTNWLAIVNTQINLIREKM KKALENQAEATKAIINYQYNQYTEEEKNNINFNIDDLSSKLNESINSAMININKFL DQCSVSYLMNSMIPYAVKRLKDFDASVRDVLLKYIYDNRGTLIGQVNRLKDKVN NTLSADIPFQLSKYVDNKKLLSTFTEYIKN |
| 33 | BoNT/A5 fragment (1-872) | MLFVNKQFNYKDPVNGVDIAYIKIPNAGQMQPVKAFKIHNKIWVIPERDTFTNPE EGDLNPPPEAKQVPVSYYDSTYLSTDNEKDNYLKGVTKLFERIYSTELGRMLLTSI VRGIPFWGGSTIDTELKVIDTNCINVIQPDGSYRSEELNLVIIGPSADIIQPECKSFGH DVLNLTRNGYGSTQYIRFSPDFTFGFEESLEVDTNPLLGA GKFATDPAVTLAHELIHAGHRLYGIAINPNRVFKVNTNAYYEMSGLEVSFEELRT FGEHDAKFIDSLQENEFRLYYYNKFKDIASTLNKAKSIVGTTASLQYMKNVFKEK YLLSEDTSGKFSVDKLKFDKLYKMLTEIYTEDNFVKFFKVLNRKTYLNFDKAVF KINIVPEVNYTIYDGFNLRNTNLAANFNGQNTEINNMNFTKLKNFTGLFEFYKLL CVRGIITSKTKSLDEGYNKALNDLCIKVNNWDLFFSPSEDNFTNDLNKGEEITSDT NIEAAEENISLDLIQQYYLTFNFDNEPENISIENLSSDIIGQLELMPNIERFPNGKKYE LDKYTMFHYLRAQEFEHGKSRIVLTNSVNEALLNPSSVYTFFSSDYVRKVNKATE AAMFLGWVEQLVYDFTDETSEVSTTDKIADITIIIPYIGPALNIGNMLYKDDFVGA LIFSGAVILLEFIPEIAIPVLGTFALVSYIANKVLTVQTIDNALSKRNEKWGEVYKYI VTNWLAKVNTQIDLIRKKMKEALENQAEATKAIINYQYNQYTEEEKNNINFNIGD LSSKLNDSINKAMININKFLNQCSVSYLMNSMIPYGVKRLEDFDASLKDALLKYI YDNRGTLIGQVDRLKDKVNNTLSTDIPFQLSKYVDNQRLLSTFTEYIKN |
| 34 | BoNT/A6 fragment (1-872) | MPFVNKQFNYKDPVNGVDIAYIKIPNAGQMQPVKAFKIHNKIWVIPERDTFTNPE EGDLNPPPEAKQVPVSYYDSTYLSTDNEKDNYLKGVTKLFERIYSTDLGRMLLTS IVRGIPFWGGSTIDTELKVIDTNCINVIQPDGSYRSEELNLVIIGPSADIIQFECKSFG HEVLNLTRNGYGSTQYIRFSPDFTFGFEESLEVDTNPLLGAGKFATDPAVTLAHEL IHAGHRLYGIAINPNRVFKVNTNAYYEMSGLEVSFEELRTFGGHDAKFIDSLQEN EFRLYYYNKFKDIASTLNKAKSIVGTTASLQYMKNVFKEKYLLSEDTSGKFSVDK LKFDKLYKMLTEIYTEDNFVKFFKVLNRKTYLNFDKAVFKINIVPKVNYTIYDGF NLRNTNLAANFNGQNTEINNMNFAKLKNFTGLFEFYKLLCVRGIITSKTKSLDKG YNKALNDLCIKVNNWDLFFSPSEDNFTNDLNKGEEITSDTNIEAAEENISLDLIQQ YYLTFNFDNEPENISIENLSSDIIGQLELMPNIERFPNGKKYELDKYTMFHYLSAQE FEHGKSRIDLTNSVNEALLNPSHVYTFFSSDYVKKVNKATEAAMFLGWVEQLVY DFTDETSEVSTTDKIADITIIIPYIGPALNIGNMLYKDDFVGALIFSGAVILLEFIPEIA IPVLGTFAIVSYIANKVLTVQTINNALSKRNEKWDEVYKYTVTNWLAKVNTQIDL IREKMKKALENQAEATKAIINYQYNQYTEEEKNNINFNIDDLSSKLNESINSAMINI NKFLDQCSVSYLMNSMIPYAVKRLKDFDASVRDVLLKYIYDNRGTLIGQVDRLK DKVNNTLSTDIPFQLSKYVDNQRLLSTFTEYIKN |
| 35 | BoNT/A7 fragment (1-872) | MPFVNKQFNYKDPVNGVDIAYIKIPNAGQMQPVKAFKIHNKIWVIPERDIFTNPEE GDLNPPPEAKQVPVSYYDSTYLSTDNEKDNYLKGVTKLFERIYSTDLGRMLLTSI VRGIPFWGGSTIDTELKVIDTNCINVIQPDGSYRSEELNLVIIGPSADIINFECKSFGH DVLNLTRNGYGSTQYIRFSPDFTFGFEESLEVDTNPLLGAGKFAIDPAVTLAHELI HAGHRLYGIAINPNRVFKVNTNAYYEMSGLEVSFEELRTFGGHDAKFIDSLQENE FRLYYYNKFKEVASILNKAKSIIGTTASLQYMKNVFKEKYLLSEDTSGKFSVDKL RFDKLYKMLTEIYTEDNFVKFFKVLNRKTYLNFDKAVFKMNIVPEVNYTIYDGF NLRNTNLAANFNGQNTEINNMNFTKLKNFTGLFEFYKLLCVRGIITSKTKSLDEG YNKALNDLCIKVNNWDLFFSPSEDNFTNDLNKGEEITSDTNIEAAEENISSDLIQQ YYLTFNFDNEPENISIENLSSDIIGQLELMPNIERFPNGKKYELDKYTMFHYLRAQE FEYGNSRIVLINSVNEALLNPSSVYTFFSSDYVKKANEATEAAMFLGWVEQLVYD FTDETSEVSTMDKIADITIIVPYIGPALNIGNMVYKKKFEEALIFSGAVILLEFVPEI VLPILGTFALVSYTSNKVLTVRTIDNALSKRNEKWEEVYKYIVTNWLAKVNTQIN LIRKKMKEALENQAEATKAIINYQYNQYTEEEKNNINFNIGDLSSKLNDSINKAMI NINKFLDQCSVSYLMNSMIPQGVKQLKDFDTSLRDSLLKYIYDNRGTLIGQVDRL KDKVNNTLSTDIPFQLSKYADNQRLLSTFTEYIKN |

TABLE 1-continued

Exemplary, non-limiting BoNT amino acid sequences

| SEQ ID NO | Description | Sequence |
| --- | --- | --- |
| 36 | BoNT/A8 fragment (1-872) | MPFVNKQFNYKDTVNGIDIAYIKIPNAGQMQPVKAFKIHNKIWVIPERDTFTNPKE GDLNPPPEAKQVPVSYYDSTYLSTDNEKDNYLKGVTKLFERIYSTDLGRMLLTSI VRGIPFWGGSTIDTELKVIDTNCINVIQPDGSYRSEELNLVIIGPSADIIQPECKSFGH DVLNLTRNGYGSTQYIRFSPDFTFGFEESLEVDTNPLLGAGKFATDPAVTLAHELI HAEHRLYGIAINPNRVFKVNTNAYYEMSGLEVSFEELRTFGGHNAKFIDSLQENE FRLYYYNKFKDIASTLNKAKSIVGTTASLQYMKNVFKEKYLLSEDTSGKFSVDKL KFDKLYKMLTEIYTEDNFVKFFKVLNRKTYLNFDKAVFKINIVPDENYTIKDGFN LKNTNLAANFNGQNTEINSRNFTKLKNFTGLFEFYKLLCVRGIIPFKTKSLDEGYN KALNDLCIKVNNWDLFFSPSEDNFTNDLDKVEEITSDTNIEAAEENISLDLIQQYY LTFDFDNEPENISIENLSSDIIGQLEPMPNIERFPNGKKYELDKYTMFHYLRAQEFE HSKSRIALTNSVNEALLNPSRVYTFFSSDYVKKVNKATEAAMFLGWVEQLVYDF TDETSEVSTTDKIADITIIIPYIGPALNIGNMLYKDDFVGALIFSGAVILLEFIPEIAIP VLGTFALVSYIANKVLTVQTIDNALSKRNEKWDEVYKYIVTNWLAKVNTQIDLV RKKMKEALENQAEATKAIINYQYNQYTEEEKNNINFNIDDLSSKLNESINSAMTNI NKFLDQCSVSYLMNSMIPYAVKRLKDFDASVREVLLKYIYDNRGTLILQVDRLK DKVNNTLSADIPFQLSKYVDNKKLLSTFTEYIKN |
| 37 | BoNT/B1 E1191M/S1199Y/I1248W/V1249W | MPVTINNFNYNDPIDNNNIIMMEPPFARGTGRYYKAFKITDRIWIIPERYTFGYKPE DFNKSSGIFNRDVCEYYDPDYLNTNDKKNIFLQTMIKLFNRIKSKPLGEKLLEMII NGIPYLGDRRVPLEEFNTNIASVTVNKLISNPGEVERKKGIFANLIIFGPGPVLNEN ETIDIGIQNHFASREGFGGIMQMKFCPEYVSVFNNVQENKGASIFNRRGYFSDPAL ILMHELIHVLHGLYGIKVDDLPIVPNEKKFFMQSTDAIQAEELYTFGGQDPSIITPS TDKSIYDKVLQNFRGIVDRLNKVLVCISDPNININIYKNKFKDKYKFVEDSEGKYS IDVESFDKLYKSLMFGFTETNIAENYKIKTRASYFSDSLPPVKIKNLLDNEIYTIEEG FNISDKDMEKEYRGQNKAINKQAYEEISKEHLAVYKIQMCKSVKAPGICIDVDNE DLFFIADKNSFSDDLSKNERIEYNTQSNYIENDFPINELILDTDLISKIELPSENTESL TDFNVDVPVYEKQPAIKKIFTDENTIFQYLYSQTFPLDIRDISLTSSFDDALLFSNK VYSFFSMDYIKTANKVVEAGLFAGWVKQIVNDFVIEANKSNTMDKIADISLIVPYI GLALNVGNETAKGNFENAFEIAGASILLEFIPELLIPVVGAFLLESYIDNKNKIIKTI DNALTKRNEKWSDMYGLIVAQWLSTVNTQFYTIKEGMYKALNYQAQALEEIIK YRYNIYSEKEKSNINIDFNDINSKLNEGINQAIDNINNFINGCSVSYLMKKMIPLAV EKLLDFDNTLKKNLLNYIDENKLYLIGSAEYEKSKVNKYLKTIMPFDLSIYTNDTI LIEMFNKYNSEILNNIILNLRYKDNNLIDLSGYGAKVEVYDGVELNDKNQFKLTSS ANSKIRVTQNQNIIFNSVFLDFSVSFWIRIPKYKNDGIQNYIHNEYTIINCMKNNSG WKISIRGNRIIWTLIDINGKTKSVFFEYNIREDISEYINRWFFVTITNNLNNAKIYIN GKLESNTDIKDIREVIANGEIIFKLDGDIDRTQFIWMKYFSIFNTELSQSNIEERYKI QSYSEYLKDFWGNPLMYNKEYYMFNAGNKNSYIKLKKDSPVGEILTRSKYNQNS KYINYRDLYIGEKFIIRRKSNSQSINDDIVRKEDYIYLDFFNLNQEWRVYTYKYFK KEEMKLFLAPIYDSDEFYNTIQIKEYDEQPTYSCQLLFKKDEESTDEIGLIGIHRFY ESGWWFEEYKDYFCISKWYLKEVKRKPYNLKLGCNWQFIPKDEGWTE |
| 38 | BoNT/B1 E1191M/S1199W/I1248W/V1249W | MPVTINNFNYNDPIDNNNIIMMEPPFARGTGRYYKAFKITDRIWIIPERYTFGYKPE DFNKSSGIFNRDVCEYYDPDYLNTNDKKNIFLQTMIKLFNRIKSKPLGEKLLEMII NGIPYLGDRRVPLEEFNTNIASVTVNKLISNPGEVERKKGIFANLIIFGPGPVLNEN ETIDIGIQNHFASREGFGGIMQMKFCPEYVSVFNNVQENKGASIFNRRGYFSDPAL ILMHELIHVLHGLYGIKVDDLPIVPNEKKFFMQSTDAIQAEELYTFGGQDPSIITPS TDKSIYDKVLQNFRGIVDRLNKVLVCISDPNININIYKNKFKDKYKFVEDSEGKYS IDVESFDKLYKSLMFGFTETNIAENYKIKTRASYFSDSLPPVKIKNLLDNEIYTIEEG FNISDKDMEKEYRGQNKAINKQAYEEISKEHLAVYKIQMCKSVKAPGICIDVDNE DLFFIADKNSFSDDLSKNERIEYNTQSNYIENDFPINELILDTDLISKIELPSENTESL TDFNVDVPVYEKQPAIKKIFTDENTIFQYLYSQTFPLDIRDISLTSSFDDALLFSNK VYSFFSMDYIKTANKVVEAGLFAGWVKQIVNDFVIEANKSNTMDKIADISLIVPYI GLALNVGNETAKGNFENAFEIAGASILLEFIPELLIPVVGAFLLESYIDNKNKIIKTI DNALTKRNEKWSDMYGLIVAQWLSTVNTQFYTIKEGMYKALNYQAQALEEIIK YRYNIYSEKEKSNINIDFNDINSKLNEGINQAIDNINNFINGCSVSYLMKKMIPLAV EKLLDFDNTLKKNLLNYIDENKLYLIGSAEYEKSKVNKYLKTIMPFDLSIYTNDTI LIEMFNKYNSEILNNIILNLRYKDNNLIDLSGYGAKVEVYDGVELNDKNQFKLTSS ANSKIRVTQNQNIIFNSVFLDFSVSFWIRIPKYKNDGIQNYIHNEYTIINCMKNNSG WKISIRGNRIIWTLIDINGKTKSVFFEYNIREDISEYINRWFFVTITNNLNNAKIYIN GKLESNTDIKDIREVIANGEIIFKLDGDIDRTQFIWMKYFSIFNTELSQSNIEERYKI QSYSEYLKDFWGNPLMYNKEYYMFNAGNKNSYIKLKKDSPVGEILTRSKYNQNS KYINYRDLYIGEKFIIRRKSNSQSINDDIVRKEDYIYLDFFNLNQEWRVYTYKYFK KEEMKLFLAPIWDSDEFYNTIQIKEYDEQPTYSCQLLFKKDEESTDEIGLIGIHRFY ESGWWFEEYKDYFCISKWYLKEVKRKPYNLKLGCNWQFIPKDEGWTE |
| 39 | BoNT/B1 E1191M/W1178Q/I1248W/V1249W | MPVTINNFNYNDPIDNNNIIMMEPPFARGTGRYYKAFKITDRIWIIPERYTFGYKPE DFNKSSGIFNRDVCEYYDPDYLNTNDKKNIFLQTMIKLFNRIKSKPLGEKLLEMII NGIPYLGDRRVPLEEFNTNIASVTVNKLISNPGEVERKKGIFANLIIFGPGPVLNEN ETIDIGIQNHFASREGFGGIMQMKFCPEYVSVFNNVQENKGASIFNRRGYFSDPAL ILMHELIHVLHGLYGIKVDDLPIVPNEKKFFMQSTDAIQAEELYTFGGQDPSIITPS TDKSIYDKVLQNFRGIVDRLNKVLVCISDPNININIYKNKFKDKYKFVEDSEGKYS IDVESFDKLYKSLMFGFTETNIAENYKIKTRASYFSDSLPPVKIKNLLDNEIYTIEEG FNISDKDMEKEYRGQNKAINKQAYEEISKEHLAVYKIQMCKSVKAPGICIDVDNE DLFFIADKNSFSDDLSKNERIEYNTQSNYIENDFPINELILDTDLISKIELPSENTESL |

TABLE 1-continued

Exemplary, non-limiting BoNT amino acid sequences

| SEQ ID NO | Description | Sequence |
|---|---|---|
| | | TDFNVDVPVYYEKQPAIKKIFTDENTIFQYLYSQTFPLDIRDISLTSSFDDALLFSNK<br>VYSFFSMDYIKTANKVVEAGLFAGWVKQIVNDFVIEANKSNTMDKIADISLIVPYI<br>GLALNVGNETAKGNFENAFEIAGASILLEFIPELLIPVVGAFLLESYIDNKNKIIKTI<br>DNALTKRNEKWSDMYGLIVAQWLSTVNTQFYTIKEGMYKALNYQAQALEEIIK<br>YRYNIYSEKEKSNINIDFNDINSKLNEGINQAIDNINNFINGCSVSYLMKKMIPLAV<br>EKLLDFDNTLKKNLLNYIDENKLYLIGSAEYEKSKVNKYLKTIMPFDLSIYTNDTI<br>LIEMFNKYNSEILNNIILNLRYKDNNLIDLSGYGAKVEVYDGVELNDKNQFKLTSS<br>ANSKIRVTQNQNIIFNSVFLDFSVSFWIRIPKYKNDGIQNYIHNEYTIINCMKNNSG<br>WKISIRGNRIIWTLIDINGKTKSVFFEYNIREDISEYINRWFFVTITNNLNNAKIYIN<br>GKLESNTDIKDIREVIANGEIIFKLDGDIDRTQFIWMKYFSIFNTELSQSNIEERYKI<br>QSYSEYLKDFWGNPLMYNKEYYMFNAGNKNSYIKLKKDSPVGEILTRSKYNQNS<br>KYINYRDLYIGEKFIIRRKSNSQSINDDIVRKEDYIYLDFFNLNQEQRVYTYKYFK<br>KEEMKLFLAPISDSDEFYNTIQIKEYDEQPTYSCQLLFKKDEESTDEIGLIGIHRFYE<br>SGWWFEEYKDYFCISKWYLKEVKRKPYNLKLGCNWQFIPKDEGWTE |
| 40 | BoNT/B1 E1191V/S1199Y/I1248W/V1249W | MPVTINNFNYNDPIDNNNIIMMEPPFARGTGRYYKAFKITDRIWIIPERYTFGYKPE<br>DFNKSSGIFNRDVCEYYDPDYLNTNDKKNIFLQTMIKLFNRIKSKPLGEKLLEMII<br>NGIPYLGDRRVPLEEFNTNIASVTVNKLISNPGEVERKKGIFANLIIFGPGPVLNEN<br>ETIDIGIQNHFASREGFGGIMQMKFCPEYVSVFNNVQENKGASIFNRRGYFSDPAL<br>ILMHELIHVLHGLYGIKVDDLPIVPNEKKFFMQSTDAIQAEELYTFGGQDPSIITPS<br>TDKSIYDKVLQNFRGIVDRLNKVLVCISDPNININIYKNKFKDKYKFVEDSEGKYS<br>IDVESFDKLYKSLMFGFTETNIAENYKIKTRASYFSDSLPPVKIKNLLDNEIYTIEEG<br>FNISDKDMEKEYRGQNKAINKQAYEEISKEHLAVYKIQMCKSVKAPGICIDVDNE<br>DLFFIADKNSFSDDLSKNERIEYNTQSNYIENDFPINELILDTDLISKIELPSENTESL<br>TDFNVDVPVYYEKQPAIKKIFTDENTIFQYLYSQTFPLDIRDISLTSSFDDALLFSNK<br>VYSFFSMDYIKTANKVVEAGLFAGWVKQIVNDFVIEANKSNTMDKIADISLIVPYI<br>GLALNVGNETAKGNFENAFEIAGASILLEFIPELLIPVVGAFLLESYIDNKNKIIKTI<br>DNALTKRNEKWSDMYGLIVAQWLSTVNTQFYTIKEGMYKALNYQAQALEEIIK<br>YRYNIYSEKEKSNINIDFNDINSKLNEGINQAIDNINNFINGCSVSYLMKKMIPLAV<br>EKLLDFDNTLKKNLLNYIDENKLYLIGSAEYEKSKVNKYLKTIMPFDLSIYTNDTI<br>LIEMFNKYNSEILNNIILNLRYKDNNLIDLSGYGAKVEVYDGVELNDKNQFKLTSS<br>ANSKIRVTQNQNIIFNSVFLDFSVSFWIRIPKYKNDGIQNYIHNEYTIINCMKNNSG<br>WKISIRGNRIIWTLIDINGKTKSVFFEYNIREDISEYINRWFFVTITNNLNNAKIYIN<br>GKLESNTDIKDIREVIANGEIIFKLDGDIDRTQFIWMKYFSIFNTELSQSNIEERYKI<br>QSYSEYLKDFWGNPLMYNKEYYMFNAGNKNSYIKLKKDSPVGEILTRSKYNQNS<br>KYINYRDLYIGEKFIIRRKSNSQSINDDIVRKEDYIYLDFFNLNQEWRVYTYKYFK<br>KEEVKLFLAPIYDSDEFYNTIQIKEYDEQPTYSCQLLFKKDEESTDEIGLIGIHRFYE<br>SGWWFEEYKDYFCISKWYLKEVKRKPYNLKLGCNWQFIPKDEGWTE |
| 41 | BoNT/B1 E1191V/S1199W/I1248W/V1249W | MPVTINNFNYNDPIDNNNIIMMEPPFARGTGRYYKAFKITDRIWIIPERYTFGYKPE<br>DFNKSSGIFNRDVCEYYDPDYLNTNDKKNIFLQTMIKLFNRIKSKPLGEKLLEMII<br>NGIPYLGDRRVPLEEFNTNIASVTVNKLISNPGEVERKKGIFANLIIFGPGPVLNEN<br>ETIDIGIQNHFASREGFGGIMQMKFCPEYVSVFNNVQENKGASIFNRRGYFSDPAL<br>ILMHELIHVLHGLYGIKVDDLPIVPNEKKFFMQSTDAIQAEELYTFGGQDPSIITPS<br>TDKSIYDKVLQNFRGIVDRLNKVLVCISDPNININIYKNKFKDKYKFVEDSEGKYS<br>IDVESFDKLYKSLMFGFTETNIAENYKIKTRASYFSDSLPPVKIKNLLDNEIYTIEEG<br>FNISDKDMEKEYRGQNKAINKQAYEEISKEHLAVYKIQMCKSVKAPGICIDVDNE<br>DLFFIADKNSFSDDLSKNERIEYNTQSNYIENDFPINELILDTDLISKIELPSENTESL<br>TDFNVDVPVYYEKQPAIKKIFTDENTIFQYLYSQTFPLDIRDISLTSSFDDALLFSNK<br>VYSFFSMDYIKTANKVVEAGLFAGWVKQIVNDFVIEANKSNTMDKIADISLIVPYI<br>GLALNVGNETAKGNFENAFEIAGASILLEFIPELLIPVVGAFLLESYIDNKNKIIKTI<br>DNALTKRNEKWSDMYGLIVAQWLSTVNTQFYTIKEGMYKALNYQAQALEEIIK<br>YRYNIYSEKEKSNINIDFNDINSKLNEGINQAIDNINNFINGCSVSYLMKKMIPLAV<br>EKLLDFDNTLKKNLLNYIDENKLYLIGSAEYEKSKVNKYLKTIMPFDLSIYTNDTI<br>LIEMFNKYNSEILNNIILNLRYKDNNLIDLSGYGAKVEVYDGVELNDKNQFKLTSS<br>ANSKIRVTQNQNIIFNSVFLDFSVSFWIRIPKYKNDGIQNYIHNEYTIINCMKNNSG<br>WKISIRGNRIIWTLIDINGKTKSVFFEYNIREDISEYINRWFFVTITNNLNNAKIYIN<br>GKLESNTDIKDIREVIANGEIIFKLDGDIDRTQFIWMKYFSIFNTELSQSNIEERYKI<br>QSYSEYLKDFWGNPLMYNKEYYMFNAGNKNSYIKLKKDSPVGEILTRSKYNQNS<br>KYINYRDLYIGEKFIIRRKSNSQSINDDIVRKEDYIYLDFFNLNQEWRVYTYKYFK<br>KEEVKLFLAPIWDSDEFYNTIQIKEYDEQPTYSCQLLFKKDEESTDEIGLIGIHRFY<br>ESGWWFEEYKDYFCISKWYLKEVKRKPYNLKLGCNWQFIPKDEGWTE |
| 42 | BoNT/B1 E1191V/S1178Q/I1248W/V1249W | MPVTINNFNYNDPIDNNNIIMMEPPFARGTGRYYKAFKITDRIWIIPERYTFGYKPE<br>DFNKSSGIFNRDVCEYYDPDYLNTNDKKNIFLQTMIKLFNRIKSKPLGEKLLEMII<br>NGIPYLGDRRVPLEEFNTNIASVTVNKLISNPGEVERKKGIFANLIIFGPGPVLNEN<br>ETIDIGIQNHFASREGFGGIMQMKFCPEYVSVFNNVQENKGASIFNRRGYFSDPAL<br>ILMHELIHVLHGLYGIKVDDLPIVPNEKKFFMQSTDAIQAEELYTFGGQDPSIITPS<br>TDKSIYDKVLQNFRGIVDRLNKVLVCISDPNININIYKNKFKDKYKFVEDSEGKYS<br>IDVESFDKLYKSLMFGFTETNIAENYKIKTRASYFSDSLPPVKIKNLLDNEIYTIEEG<br>FNISDKDMEKEYRGQNKAINKQAYEEISKEHLAVYKIQMCKSVKAPGICIDVDNE<br>DLFFIADKNSFSDDLSKNERIEYNTQSNYIENDFPINELILDTDLISKIELPSENTESL<br>TDFNVDVPVYYEKQPAIKKIFTDENTIFQYLYSQTFPLDIRDISLTSSFDDALLFSNK<br>VYSFFSMDYIKTANKVVEAGLFAGWVKQIVNDFVIEANKSNTMDKIADISLIVPYI |

TABLE 1-continued

| SEQ ID NO | Description | Sequence |
|---|---|---|
| | | Exemplary, non-limiting BoNT amino acid sequences |
| | | GLALNVGNETAKGNFENAFEIAGASILLEFIPELLIPVVGAFLLESYIDNKNKIIKTI DNALTKRNEKWSDMYGLIVAQWLSTVNTQFYTIKEGMYKALNYQAQALEEIIK YRYNIYSEKEKSNINIDFNDINSKLNEGINQAIDNINNFINGCSVSYLMKKMIPLAV EKLLDFDNTLKKNLLNYIDENKLYLIGSAEYEKSKVNKYLKTIMPFDLSIYTNDTI LIEMFNKYNSEILNNIILNLRYKDNNLIDLSGYGAKVEVYDGVELNDKNQFKLTSS ANSKIRVTQNQNIIFNSVFLDFSVSFWIRIPKYKNDGIQNYIHNEYTIINCMKNNSG WKISIRGNRIIWTLIDINGKTKSVFFEYNIREDISEYINRWFFVTITNNLNNAKIYIN GKLESNTDIKDIREVIANGEIIFKLDGDIDRTQFIWMKYFSIFNTELSQSNIEERYKI QSYSEYLKDFWGNPLMYNKEYYMFNAGNKNSYIKLKKDSPVGEILTRSKYNQNS KYINYRDLYIGEKFIIRRKSNSQSINDDIVRKEDYIYLDFFNLNQEQRVYTYKYFK KEEVKLFLAPISDSDEFYNTIQIKEYDEQPTYSCQLLFKKDEESTDEIGLIGIHRFYE SGWWFEEYKDYFCISKWYLKEVKRKPYNLKLGCNWQFIPKDEGWTE |
| 43 | BoNT/B1 E1191Q/S1199Y/I1248W/V1249W | MPVTINNFNYNDPIDNNNIIMMEPPFARGTGRYYKAFKITDRIWIIPERYTFGYKPE DFNKSSGIFNRDVCEYYDPDYLNTNDKKNIFLQTMIKLFNRIKSKPLGEKLLEMII NGIPYLGDRRVPLEEFNTNIASVTVNKLISNPGEVERKKGIFANLIIFGPGPVLNEN ETIDIGIQNHFASREGFGGIMQMKFCPEYVSVFNNVQENKGASIFNRRGYFSDPAL ILMHELIHVLHGLYGIKVDDLPIVPNEKKFFMQSTDAIQAEELYTFGGQDPSIITPS TDKSIYDKVLQNFRGIVDRLNKVLVCISDPNININIYKNKFKDKYKFVEDSEGKYS IDVESFDKLYKSLMFGFTETNIAENYKIKTRASYFSDSLPPVKIKNLLDNEIYTIEEG FNISDKDMEKEYRGQNKAINKQAYEEISKEHLAVYKIQMCKSVKAPGICIDVDNE DLFFIADKNSFSDDLSKNERIEYNTQSNYIENDFPINELILDTDLISKIELPSENTESL TDFNVDVPVYEKQPAIKKIFTDENTIFQYLYSQTFPLDIRDISLTSSFDDALLFSNK VYSFFSMDYIKTANKVVEAGLFAGWVKQIVNDFVIEANKSNTMDKIADISLIVPYI GLALNVGNETAKGNFENAFEIAGASILLEFIPELLIPVVGAFLLESYIDNKNKIIKTI DNALTKRNEKWSDMYGLIVAQWLSTVNTQFYTIKEGMYKALNYQAQALEEIIK YRYNIYSEKEKSNINIDFNDINSKLNEGINQAIDNINNFINGCSVSYLMKKMIPLAV EKLLDFDNTLKKNLLNYIDENKLYLIGSAEYEKSKVNKYLKTIMPFDLSIYTNDTI LIEMFNKYNSEILNNIILNLRYKDNNLIDLSGYGAKVEVYDGVELNDKNQFKLTSS ANSKIRVTQNQNIIFNSVFLDFSVSFWIRIPKYKNDGIQNYIHNEYTIINCMKNNSG WKISIRGNRIIWTLIDINGKTKSVFFEYNIREDISEYINRWFFVTITNNLNNAKIYIN GKLESNTDIKDIREVIANGEIIFKLDGDIDRTQFIWMKYFSIFNTELSQSNIEERYKI QSYSEYLKDFWGNPLMYNKEYYMFNAGNKNSYIKLKKDSPVGEILTRSKYNQNS KYINYRDLYIGEKFIIRRKSNSQSINDDIVRKEDYIYLDFFNLNQEWRVYTYKYFK KEEQKLFLAPIYDSDEFYNTIQIKEYDEQPTYSCQLLFKKDEESTDEIGLIGIHRFYE SGWWFEEYKDYFCISKWYLKEVKRKPYNLKLGCNWQFIPKDEGWTE |
| 44 | BoNT/B1 receptor binding domain E332M/S340Y/I389W/V390W | ILNNIILNLRYKDNNLIDLSGYGAKVEVYDGVELNDKNQFKLTSSANSKIRVTQN QNIIFNSVFLDFSVSFWIRIPKYKNDGIQNYIHNEYTIINCMKNNSGWKISIRGNRII WTLIDINGKTKSVFFEYNIREDISEYINRWFFVTITNNLNNAKIYINGKLESNTDIK DIREVIANGEIIFKLDGDIDRTQFIWMKYFSIFNTELSQSNIEERYKIQSYSEYLKDF WGNPLMYNKEYYMFNAGNKNSYIKLKKDSPVGEILTRSKYNQNSKYINYRDLYI GEKFIIRRKSNSQSINDDIVRKEDYIYLDFFNLNQEWRVYTYKYFKKEEMKLFLAP IYDSDEFYNTIQIKEYDEQPTYSCQLLFKKDEESTDEIGLIGIHRFYESGWWPEEYK DYFCISKWYLKEVKRKPYNLKLGCNWQFIPKDEGWTE |
| 45 | BoNT/B1 receptor binding domain E332M/S340W/I389W/V390W | ILNNIILNLRYKDNNLIDLSGYGAKVEVYDGVELNDKNQFKLTSSANSKIRVTQN QNIIFNSVFLDFSVSFWIRIPKYKNDGIQNYIHNEYTIINCMKNNSGWKISIRGNRII WTLIDINGKTKSVFFEYNIREDISEYINRWFFVTITNNLNNAKIYINGKLESNTDIK DIREVIANGEIIFKLDGDIDRTQFIWMKYFSIFNTELSQSNIEERYKIQSYSEYLKDF WGNPLMYNKEYYMFNAGNKNSYIKLKKDSPVGEILTRSKYNQNSKYINYRDLYI GEKFIIRRKSNSQSINDDIVRKEDYIYLDFFNLNQEWRVYTYKYFKKEEMKLFLAP IWDSDEFYNTIQIKEYDEQPTYSCQLLFKKDEESTDEIGLIGIHRFYESGWWFEEY KDYFCISKWYLKEVKRKPYNLKLGCNWQFIPKDEGWTE |
| 46 | BoNT/B1 receptor binding domain E332M/W318Q/I389W/V390W | ILNNIILNLRYKDNNLIDLSGYGAKVEVYDGVELNDKNQFKLTSSANSKIRVTQN QNIIFNSVFLDFSVSFWIRIPKYKNDGIQNYIHNEYTIINCMKNNSGWKISIRGNRII WTLIDINGKTKSVFFEYNIREDISEYINRWFFVTITNNLNNAKIYINGKLESNTDIK DIREVIANGEIIFKLDGDIDRTQFIWMKYFSIFNTELSQSNIEERYKIQSYSEYLKDF WGNPLMYNKEYYMFNAGNKNSYIKLKKDSPVGEILTRSKYNQNSKYINYRDLYI GEKFIIRRKSNSQSINDDIVRKEDYIYLDFFNLNQEQRVYTYKYFKKEEMKLFLAPI SDSDEFYNTIQIKEYDEQPTYSCQLLFKKDEESTDEIGLIGIHRFYESGWWPEEYK DYFCISKWYLKEVKRKPYNLKLGCNWQFIPKDEGWTE |
| 47 | BoNT/B1 receptor binding domain E332V/W318Q/I389W/V390W | ILNNIILNLRYKDNNLIDLSGYGAKVEVYDGVELNDKNQFKLTSSANSKIRVTQN QNIIFNSVFLDFSVSFWIRIPKYKNDGIQNYIHNEYTIINCMKNNSGWKISIRGNRII WTLIDINGKTKSVFFEYNIREDISEYINRWFFVTITNNLNNAKIYINGKLESNTDIK DIREVIANGEIIFKLDGDIDRTQFIWMKYFSIFNTELSQSNIEERYKIQSYSEYLKDF WGNPLMYNKEYYMFNAGNKNSYIKLKKDSPVGEILTRSKYNQNSKYINYRDLYI GEKFIIRRKSNSQSINDDIVRKEDYIYLDFFNLNQEQRVYTYKYFKKEEVKLFLAPI SDSDEFYNTIQIKEYDEQPTYSCQLLFKKDEESTDEIGLIGIHRFYESGWWPEEYK DYFCISKWYLKEVKRKPYNLKLGCNWQFIPKDEGWTE |

TABLE 1-continued

Exemplary, non-limiting BoNT amino acid sequences

| SEQ ID NO | Description | Sequence |
|---|---|---|
| 48 | BoNT/B1 receptor binding domain E332V/S340 Y/I389W/V 390W | ILNNIILNLRYKDNNLIDLSGYGAKVEVYDGVELNDKNQFKLTSSANSKIRVTQN QNIIFNSVFLDFSVSFWIRIPKYKNDGIQNYIHNEYTIINCMKNNSGWKISIRGNRII WTLIDINGKTKSVFFEYNIREDISEYINRWFFVTITNNLNNAKIYINGKLESNTDIK DIREVIANGEIIFKLDGDIDRTQFIWMKYFSIFNTELSQSNIEERYKIQSYSEYLKDF WGNPLMYNKEYYMFNAGNKNSYIKLKKDSPVGEILTRSKYNQNSKYINYRDLYI GEKFIIRRKSNSQSINDDIVRKEDYIYLDFFNLNQEWRVYTYKYFKKEEVKLFLAP IYDSDEFYNTIQIKEYDEQPTYSCQLLFKKDEESTDEIGLIGIHRFYESGWWPEEYK DYFCISKWYLKEVKRKPYNLKLGCNWQFIPKDEGWTE |
| 49 | BoNT/B1 receptor binding domain E332V/S340 W/I389W/V 390W | ILNNIILNLRYKDNNLIDLSGYGAKVEVYDGVELNDKNQFKLTSSANSKIRVTQN QNIIFNSVFLDFSVSFWIRIPKYKNDGIQNYIHNEYTIINCMKNNSGWKISIRGNRII WTLIDINGKTKSVFFEYNIREDISEYINRWFFVTITNNLNNAKIYINGKLESNTDIK DIREVIANGEIIFKLDGDIDRTQFIWMKYFSIFNTELSQSNIEERYKIQSYSEYLKDF WGNPLMYNKEYYMFNAGNKNSYIKLKKDSPVGEILTRSKYNQNSKYINYRDLYI GEKFIIRRKSNSQSINDDIVRKEDYIYLDFFNLNQEWRVYTYKYFKKEEVKLFLAP IWDSDEFYNTIQIKEYDEQPTYSCQLLFKKDEESTDEIGLIGIHRFYESGWWFEEY KDYFCISKWYLKEVKRKPYNLKLGCNWQFIPKDEGWTE |
| 50 | BoNT/B1 receptor binding domain E332Q/S340 Y/I389WN 390W | ILNNIILNLRYKDNNLIDLSGYGAKVEVYDGVELNDKNQFKLTSSANSKIRVTQN QNIIFNSVFLDFSVSFWIRIPKYKNDGIQNYIHNEYTIINCMKNNSGWKISIRGNRII WTLIDINGKTKSVFFEYNIREDISEYINRWFFVTITNNLNNAKIYINGKLESNTDIK DIREVIANGEIIFKLDGDIDRTQFIWMKYFSIFNTELSQSNIEERYKIQSYSEYLKDF WGNPLMYNKEYYMFNAGNKNSYIKLKKDSPVGEILTRSKYNQNSKYINYRDLYI GEKFIIRRKSNSQSINDDIVRKEDYIYLDFFNLNQEWRVYTYKYFKKEEQKLFLAP IYDSDEFYNTIQIKEYDEQPTYSCQLLFKKDEESTDEIGLIGIHRFYESGWWPEEYK DYFCISKWYLKEVKRKPYNLKLGCNWQFIPKDEGWTE |
| 51 | Chimeric toxin BoNT/A1-B1 E1204M/S1 212Y/I1261 W/V1262W | MPFVNKQFNYKDPVNGVDIAYIKIPNAGQMQPVKAFKIHNKIWVIPERDTFTNPE EGDLNPPPEAKQVPVSYYDSTYLSTDNEKDNYLKGVTKLFERIYSTDLGRMLLTS IVRGIPFWGGSTIDTELKVIDTNCINVIQPDGSYRSEELNLVIIGPSADIIQFECKSFG HEVLNLTRNGYGSTQYIRFSPDFTFGFEESLEVDTNPLLGAGKFATDPAVTLAHEL IHAGHRLYGIAINPNRVFKVNTNAYYEMSGLEVSFEELRTFGGHDAKFIDSLQEN EFRLYYYNKFKDIASTLNKAKSIVGTTASLQYMKNVFKEKYLLSEDTSGKFSVDK LKFDKLYKMLTEIYTEDNFVKFFKVLNRKTYLNFDKAVFKINIVPKVNYTIYDGF NLRNTNLAANFNGQNTEINNMNFTKLKNFTGLFEFYKLLCVRGIITSKTKSLDKG YNKALNDLCIKVNNWDLFFSPSEDNFTNDLNKGEEITSDTNIEAAEENISLDLIQQ YYLTFNFDNEPENISIENLSSDIIGQLELMPNIERFPNGKKYELDKYTMFHYLRAQE FEHGKSRIALTNSVNEALLNPSRVYTFFSSDYVKKVNKATEAAMFLGWVEQLVY DFTDETSEVSTTDKIADITIIIPYIGPALNIGNMLYKDDFVGALIFSGAVILLEFIPEIA IPVLGTFALVSYIANKVLTVQTIDNALSKRNEKWDEVYKYIVTNWLAKVNTQIDL IRKKMKEALENQAEATKAIINYQYNQYTEEEKNNINFNIDDLSSKLNESINKAMIN INKFLNQCSVSYLMNSMIPYGVKRLEDFDASLKDALLKYIYDNRGTLIGQVDRLK DKVNNTLSTDIPFQLSKYVDNQRLLSTFTEYIKNILNNIILNLRYKDNNLIDLSGYG AKVEVYDGVELNDKNQFKLTSSANSKIRVTQNQNIIFNSVFLDFSVSFWIRIPKYK NDGIQNYIHNEYTIINCMKNNSGWKISIRGNRIIWTLIDINGKTKSVFFEYNIREDIS EYINRWFFVTITNNLNNAKIYINGKLESNTDIKDIREVIANGEIIFKLDGDIDRTQFI WMKYFSIFNTELSQSNIEERYKIQSYSEYLKDFWGNPLMYNKEYYMFNAGNKNS YIKLKKDSPVGEILTRSKYNQNSKYINYRDLYIGEKFIIRRKSNSQSINDDIVRKED YIYLDFFNLNQEWRVYTYKYFKKEEMKLFLAPIYDSDEFYNTIQIKEYDEQPTYS CQLLFKKDEESTDEIGLIGIHRFYESGWWFEEYKDYFCISKWYLKEVKRKPYNLK LGCNWQFIPKDEGWTE |
| 52 | Chimeric toxin BoNT/A1-B1 E1204M/S1 212W/I1261 W/V1262W | MPFVNKQFNYKDPVNGVDIAYIKIPNAGQMQPVKAFKIHNKIWVIPERDTFTNPE EGDLNPPPEAKQVPVSYYDSTYLSTDNEKDNYLKGVTKLFERIYSTDLGRMLLTS IVRGIPFWGGSTIDTELKVIDTNCINVIQPDGSYRSEELNLVIIGPSADIIQFECKSFG HEVLNLTRNGYGSTQYIRFSPDFTFGFEESLEVDTNPLLGAGKFATDPAVTLAHEL IHAGHRLYGIAINPNRVFKVNTNAYYEMSGLEVSFEELRTFGGHDAKFIDSLQEN EFRLYYYNKFKDIASTLNKAKSIVGTTASLQYMKNVFKEKYLLSEDTSGKFSVDK LKFDKLYKMLTEIYTEDNFVKFFKVLNRKTYLNFDKAVFKINIVPKVNYTIYDGF NLRNTNLAANFNGQNTEINNMNFTKLKNFTGLFEFYKLLCVRGIITSKTKSLDKG YNKALNDLCIKVNNWDLFFSPSEDNFTNDLNKGEEITSDTNIEAAEENISLDLIQQ YYLTFNFDNEPENISIENLSSDIIGQLELMPNIERFPNGKKYELDKYTMFHYLRAQE FEHGKSRIALTNSVNEALLNPSRVYTFFSSDYVKKVNKATEAAMFLGWVEQLVY DFTDETSEVSTTDKIADITIIIPYIGPALNIGNMLYKDDFVGALIFSGAVILLEFIPEIA IPVLGTFALVSYIANKVLTVQTIDNALSKRNEKWDEVYKYIVTNWLAKVNTQIDL IRKKMKEALENQAEATKAIINYQYNQYTEEEKNNINFNIDDLSSKLNESINKAMIN INKFLNQCSVSYLMNSMIPYGVKRLEDFDASLKDALLKYIYDNRGTLIGQVDRLK DKVNNTLSTDIPFQLSKYVDNQRLLSTFTEYIKNILNNIILNLRYKDNNLIDLSGYG AKVEVYDGVELNDKNQFKLTSSANSKIRVTQNQNIIFNSVFLDFSVSFWIRIPKYK NDGIQNYIHNEYTIINCMKNNSGWKISIRGNRIIWTLIDINGKTKSVFFEYNIREDIS EYINRWFFVTITNNLNNAKIYINGKLESNTDIKDIREVIANGEIIFKLDGDIDRTQFI WMKYFSIFNTELSQSNIEERYKIQSYSEYLKDFWGNPLMYNKEYYMFNAGNKNS YIKLKKDSPVGEILTRSKYNQNSKYINYRDLYIGEKFIIRRKSNSQSINDDIVRKED |

TABLE 1-continued

Exemplary, non-limiting BoNT amino acid sequences

| SEQ ID NO | Description | Sequence |
| --- | --- | --- |
| | | YIYLDFFNLNQEWRVYTYKYFKKEEMKLFLAPIWDSDEFYNTIQIKEYDEQPTYS<br>CQLLFKKDEESTDEIGLIGIHRFYESGWWFEEYKDYFCISKWYLKEVKRKPYNLK<br>LGCNWQFIPKDEGWTE |
| 53 | Chimeric<br>toxin<br>BoNT/A1-<br>B1<br>E1204M/W<br>1191Q/I126<br>1W/V1262<br>W | MPFVNKQFNYKDPVNGVDIAYIKIPNAGQMQPVKAFKIHNKIWVIPERDTFTNPE<br>EGDLNPPPEAKQVPVSYYDSTYLSTDNEKDNYLKGVTKLFERIYSTDLGRMLLTS<br>IVRGIPFWGGSTIDTELKVIDTNCINVIQPDGSYRSEELNLVIIGPSADIIQFECKSFG<br>HEVLNLTRNGYGSTQYIRFSPDFTFGFEESLEVDTNPLLGAGKFATDPAVTLAHEL<br>IHAGHRLYGIAINPNRVFKVNTNAYYEMSGLEVSFEELRTFGGHDAKFIDSLQEN<br>EFRLYYYNKFKDIASTLNKAKSIVGTTASLQYMKNVFKEKYLLSEDTSGKFSVDK<br>LKFDKLYKMLTEIYTEDNFVKFFKVLNRKTYLNFDKAVFKINIVPKVNYTIYDGF<br>NLRNTNLAANFNGQNTEINNMNFTKLKNFTGLFEFYKLLCVRGIITSKTKSLDKG<br>YNKALNDLCIKVNNWDLFFSPSEDNFTNDLNKGEEITSDTNIEAAEENISLDLIQQ<br>YYLTFNFDNEPENISIENLSSDIIGQLELMPNIERFPNGKKYELDKYTMFHYLRAQE<br>FEHGKSRIALTNSVNEALLNPSRVYTFFSSDYVKKVNKATEAAMFLGWVEQLVY<br>DFTDETSEVSTTDKIADITIIIPYIGPALNIGNMLYKDDFVGALIFSGAVILLEFIPEIA<br>IPVLGTFALVSYIANKVLTVQTIDNALSKRNEKWDEVYKYIVTNWLAKVNTQIDL<br>IRKKMKEALENQAEATKAIINYQYNQYTEEEKNNINFNIDDLSSKLNESINKAMIN<br>INKFLNQCSVSYLMNSMIPYGVKRLEDFDASLKDALLKYIYDNRGTLIGQVDRLK<br>DKVNNTLSTDIPFQLSKYVDNQRLLSTFTEYIKNILNNIILNLRYKDNNLIDLSGYG<br>AKVEVYDGVELNDKNQFKLTSSANSKIRVTQNQNIIFNSVFLDFSVSFWIRIPKYK<br>NDGIQNYIHNEYTIINCMKNNSGWKISIRGNRIIWTLIDINGKTKSVFFEYNIREDIS<br>EYINRWFFVTITNNLNNAKIYINGKLESNTDIKDIREVIANGEIIFKLDGDIDRTQFI<br>WMKYFSIFNTELSQSNIEERYKIQSYSEYLKDFWGNPLMYNKEYYMFNAGNKNS<br>YIKLKKDSPVGEILTRSKYNQNSKYINYRDLYIGEKFIIRRKSNSQSINDDIVRKED<br>YIYLDFFNLNQEQRVYTYKYFKKEEMKLFLAPISDSDEFYNTIQIKEYDEQPTYSC<br>QLLFKKDEESTDEIGLIGIHRFYESGWWFEEYKDYFCISKWYLKEVKRKPYNLKL<br>GCNWQFIPKDEGWTE |
| 54 | Chimeric<br>toxin<br>BoNT/A1-<br>B1<br>E1204V/S12<br>12Y/I1261<br>W/V1262W | MPFVNKQFNYKDPVNGVDIAYIKIPNAGQMQPVKAFKIHNKIWVIPERDTFTNPE<br>EGDLNPPPEAKQVPVSYYDSTYLSTDNEKDNYLKGVTKLFERIYSTDLGRMLLTS<br>IVRGIPFWGGSTIDTELKVIDTNCINVIQPDGSYRSEELNLVIIGPSADIIQFECKSFG<br>HEVLNLTRNGYGSTQYIRFSPDFTFGFEESLEVDTNPLLGAGKFATDPAVTLAHEL<br>IHAGHRLYGIAINPNRVFKVNTNAYYEMSGLEVSFEELRTFGGHDAKFIDSLQEN<br>EFRLYYYNKFKDIASTLNKAKSIVGTTASLQYMKNVFKEKYLLSEDTSGKFSVDK<br>LKFDKLYKMLTEIYTEDNFVKFFKVLNRKTYLNFDKAVFKINIVPKVNYTIYDGF<br>NLRNTNLAANFNGQNTEINNMNFTKLKNFTGLFEFYKLLCVRGIITSKTKSLDKG<br>YNKALNDLCIKVNNWDLFFSPSEDNFTNDLNKGEEITSDTNIEAAEENISLDLIQQ<br>YYLTFNFDNEPENISIENLSSDIIGQLELMPNIERFPNGKKYELDKYTMFHYLRAQE<br>FEHGKSRIALTNSVNEALLNPSRVYTFFSSDYVKKVNKATEAAMFLGWVEQLVY<br>DFTDETSEVSTTDKIADITIIIPYIGPALNIGNMLYKDDFVGALIFSGAVILLEFIPEIA<br>IPVLGTFALVSYIANKVLTVQTIDNALSKRNEKWDEVYKYIVTNWLAKVNTQIDL<br>IRKKMKEALENQAEATKAIINYQYNQYTEEEKNNINFNIDDLSSKLNESINKAMIN<br>INKFLNQCSVSYLMNSMIPYGVKRLEDFDASLKDALLKYIYDNRGTLIGQVDRLK<br>DKVNNTLSTDIPFQLSKYVDNQRLLSTFTEYIKNILNNIILNLRYKDNNLIDLSGYG<br>AKVEVYDGVELNDKNQFKLTSSANSKIRVTQNQNIIFNSVFLDFSVSFWIRIPKYK<br>NDGIQNYIHNEYTIINCMKNNSGWKISIRGNRIIWTLIDINGKTKSVFFEYNIREDIS<br>EYINRWFFVTITNNLNNAKIYINGKLESNTDIKDIREVIANGEIIFKLDGDIDRTQFI<br>WMKYFSIFNTELSQSNIEERYKIQSYSEYLKDFWGNPLMYNKEYYMFNAGNKNS<br>YIKLKKDSPVGEILTRSKYNQNSKYINYRDLYIGEKFIIRRKSNSQSINDDIVRKED<br>YIYLDFFNLNQEWRVYTYKYFKKEEVKLFLAPIYDSDEFYNTIQIKEYDEQPTYSC<br>QLLFKKDEESTDEIGLIGIHRFYESGWWFEEYKDYFCISKWYLKEVKRKPYNLKL<br>GCNWQFIPKDEGWTE |
| 55 | Chimeric<br>toxin<br>BoNT/A1-<br>B1<br>E1204V/S12<br>12W/I1262<br>W/V1262W | MPFVNKQFNYKDPVNGVDIAYIKIPNAGQMQPVKAFKIHNKIWVIPERDTFTNPE<br>EGDLNPPPEAKQVPVSYYDSTYLSTDNEKDNYLKGVTKLFERIYSTDLGRMLLTS<br>IVRGIPFWGGSTIDTELKVIDTNCINVIQPDGSYRSEELNLVIIGPSADIIQFECKSFG<br>HEVLNLTRNGYGSTQYIRFSPDFTFGFEESLEVDTNPLLGAGKFATDPAVTLAHEL<br>IHAGHRLYGIAINPNRVFKVNTNAYYEMSGLEVSFEELRTFGGHDAKFIDSLQEN<br>EFRLYYYNKFKDIASTLNKAKSIVGTTASLQYMKNVFKEKYLLSEDTSGKFSVDK<br>LKFDKLYKMLTEIYTEDNFVKFFKVLNRKTYLNFDKAVFKINIVPKVNYTIYDGF<br>NLRNTNLAANFNGQNTEINNMNFTKLKNFTGLFEFYKLLCVRGIITSKTKSLDKG<br>YNKALNDLCIKVNNWDLFFSPSEDNFTNDLNKGEEITSDTNIEAAEENISLDLIQQ<br>YYLTFNFDNEPENISIENLSSDIIGQLELMPNIERFPNGKKYELDKYTMFHYLRAQE<br>FEHGKSRIALTNSVNEALLNPSRVYTFFSSDYVKKVNKATEAAMFLGWVEQLVY<br>DFTDETSEVSTTDKIADITIIIPYIGPALNIGNMLYKDDFVGALIFSGAVILLEFIPEIA<br>IPVLGTFALVSYIANKVLTVQTIDNALSKRNEKWDEVYKYIVTNWLAKVNTQIDL<br>IRKKMKEALENQAEATKAIINYQYNQYTEEEKNNINFNIDDLSSKLNESINKAMIN<br>INKFLNQCSVSYLMNSMIPYGVKRLEDFDASLKDALLKYIYDNRGTLIGQVDRLK<br>DKVNNTLSTDIPFQLSKYVDNQRLLSTFTEYIKNILNNIILNLRYKDNNLIDLSGYG<br>AKVEVYDGVELNDKNQFKLTSSANSKIRVTQNQNIIFNSVFLDFSVSFWIRIPKYK<br>NDGIQNYIHNEYTIINCMKNNSGWKISIRGNRIIWTLIDINGKTKSVFFEYNIREDIS<br>EYINRWFFVTITNNLNNAKIYINGKLESNTDIKDIREVIANGEIIFKLDGDIDRTQFI<br>WMKYFSIFNTELSQSNIEERYKIQSYSEYLKDFWGNPLMYNKEYYMFNAGNKNS |

TABLE 1-continued

| SEQ ID NO | Description | Sequence |
|---|---|---|
| | | YIKLKKDSPVGEILTRSKYNQNSKYINYRDLYIGEKFIIRRKSNSQSINDDIVRKED YIYLDFFNLNQEWRVYTYKYFKKEEVKLFLAPIWDSDEFYNTIQIKEYDEQPTYS CQLLFKKDEESTDEIGLIGIHRFYESGWWFEEYKDYFCISKWYLKEVKRKPYNLK LGCNWQFIPKDEGWTE |
| 56 | Chimeric toxin BoNT/A1-B1 E1204V/W1191Q/I1262W/V1262W | MPFVNKQFNYKDPVNGVDIAYIKIPNAGQMQPVKAFKIHNKIWVIPERDTFTNPE EGDLNPPPEAKQVPVSYYDSTYLSTDNEKDNYLKGVTKLFERIYSTDLGRMLLTS IVRGIPFWGGSTIDTELKVIDTNCINVIQPDGSYRSEELNLVIIGPSADIIQFECKSFG HEVLNLTRNGYGSTQYIRFSPDFTFGFEESLEVDTNPLLGAGKFATDPAVTLAHEL IHAGHRLYGIAINPNRVFKVNTNAYYEMSGLEVSFEELRTFGGHDAKFIDSLQEN EFRLYYYNKFKDIASTLNKAKSIVGTTASLQYMKNVFKEKYLLSEDTSGKFSVDK LKFDKLYKMLTEIYTEDNFVKFFKVLNRKTYLNFDKAVFKINIVPKVNYTIYDGF NLRNTNLAANFNGQNTEINNMNFTKLKNFTGLFEFYKLLCVRGIITSKTKSLDKG YNKALNDLCIKVNNWDLFFSPSEDNFTNDLNKGEEITSDTNIEAAEENISLDLIQQ YYLTFNFDNEPENISIENLSSDIIGQLELMPNIERFPNGKKYELDKYTMFHYLRAQE FEHGKSRIALTNSVNEALLNPSRVYTFFSSDYVKKVNKATEAAMFLGWVEQLVY DFTDETSEVSTTDKIADITIIIPYIGPALNIGNMLYKDDFVGALIFSGAVILLEFIPEIA IPVLGTFALVSYIANKVLTVQTIDNALSKRNEKWDEVYKYIVTNWLAKVNTQIDL IRKKMKEALENQAEATKAIINYQYNQYTEEEKNNINFNIDDLSSKLNESINKAMIN INKFLNQCSVSYLMNSMIPYGVKRLEDFDASLKDALLKYIYDNRGTLIGQVDRLK DKVNNTLSTDIPFQLSKYVDNQRLLSTFTEYIKNILNNIILNLRYKDNNLIDLSGYG AKVEVYDGVELNDKNQFKLTSSANSKIRVTQNQNIIFNSVFLDFSVSFWIRIPKYK NDGIQNYIHNEYTIINCMKNNSGWKISIRGNRIIWTLIDINGKTKSVFFEYNIREDIS EYINRWFFVTITNNLNNAKIYINGKLESNTDIKDIREVIANGEIIFKLDGDIDRTQFI WMKYFSIFNTELSQSNIEERYKIQSYSEYLKDFWGNPLMYNKEYYMFNAGNKNS YIKLKKDSPVGEILTRSKYNQNSKYINYRDLYIGEKFIIRRKSNSQSINDDIVRKED YIYLDFFNLNQEQRVYTYKYFKKEEVKLFLAPISDSDEFYNTIQIKEYDEQPTYSC QLLFKKDEESTDEIGLIGIHRFYESGWWFEEYKDYFCISKWYLKEVKRKPYNLKL GCNWQFIPKDEGWTE |
| 57 | Chimeric toxin BoNT/A1-B1 E1204Q/S1212Y/I1261W/V1262W | MPFVNKQFNYKDPVNGVDIAYIKIPNAGQMQPVKAFKIHNKIWVIPERDTFTNPE EGDLNPPPEAKQVPVSYYDSTYLSTDNEKDNYLKGVTKLFERIYSTDLGRMLLTS IVRGIPFWGGSTIDTELKVIDTNCINVIQPDGSYRSEELNLVIIGPSADIIQFECKSFG HEVLNLTRNGYGSTQYIRFSPDFTFGFEESLEVDTNPLLGAGKFATDPAVTLAHEL IHAGHRLYGIAINPNRVFKVNTNAYYEMSGLEVSFEELRTFGGHDAKFIDSLQEN EFRLYYYNKFKDIASTLNKAKSIVGTTASLQYMKNVFKEKYLLSEDTSGKFSVDK LKFDKLYKMLTEIYTEDNFVKFFKVLNRKTYLNFDKAVFKINIVPKVNYTIYDGF NLRNTNLAANFNGQNTEINNMNFTKLKNFTGLFEFYKLLCVRGIITSKTKSLDKG YNKALNDLCIKVNNWDLFFSPSEDNFTNDLNKGEEITSDTNIEAAEENISLDLIQQ YYLTFNFDNEPENISIENLSSDIIGQLELMPNIERFPNGKKYELDKYTMFHYLRAQE FEHGKSRIALTNSVNEALLNPSRVYTFFSSDYVKKVNKATEAAMFLGWVEQLVY DFTDETSEVSTTDKIADITIIIPYIGPALNIGNMLYKDDFVGALIFSGAVILLEFIPEIA IPVLGTFALVSYIANKVLTVQTIDNALSKRNEKWDEVYKYIVTNWLAKVNTQIDL IRKKMKEALENQAEATKAIINYQYNQYTEEEKNNINFNIDDLSSKLNESINKAMIN INKFLNQCSVSYLMNSMIPYGVKRLEDFDASLKDALLKYIYDNRGTLIGQVDRLK DKVNNTLSTDIPFQLSKYVDNQRLLSTFTEYIKNILNNIILNLRYKDNNLIDLSGYG AKVEVYDGVELNDKNQFKLTSSANSKIRVTQNQNIIFNSVFLDFSVSFWIRIPKYK NDGIQNYIHNEYTIINCMKNNSGWKISIRGNRIIWTLIDINGKTKSVFFEYNIREDIS EYINRWFFVTITNNLNNAKIYINGKLESNTDIKDIREVIANGEIIFKLDGDIDRTQFI WMKYFSIFNTELSQSNIEERYKIQSYSEYLKDFWGNPLMYNKEYYMFNAGNKNS YIKLKKDSPVGEILTRSKYNQNSKYINYRDLYIGEKFIIRRKSNSQSINDDIVRKED YIYLDFFNLNQEWRVYTYKYFKKEEQKLFLAPIYDSDEFYNTIQIKEYDEQPTYSC QLLFKKDEESTDEIGLIGIHRFYESGWWFEEYKDYFCISKWYLKEVKRKPYNLKL GCNWQFIPKDEGWTE |
| 58 | WT BoNT/X | MKLEINKFNYNDPIDGINVITMRPPRHSDKINKGKGPFKAFQVIKNIWIVPERYNF TNNTNDLNIPSEPIMEADAIYNPNYLNTPSEKDEFLQGVIKVLERIKSKPEGEKLLE LISSSIPLPLVSNGALTLSDNETIAYQENNNIVSNLQANLVIYGPGPDIANNATYGL YSTPISNGEGTLSEVSFSPFYLKPFDESYGNYRSLVNIVNKFVKREFAPDPASTLM HELVHVTHNLYGISNRNFYYNFDTGKIETSRQQNSLIFEELLTFGGIDSKAISSLII KKIIETAKNNYTTLISERLNTVTVENDLLKYIKNKIPVQGRLGNFKLDTAEFEKKL NTILFVLNESNLAQRFSILVRKHYLKERPIDPIYVNILDDNSYSTLEGFNISSQGSND FQGQLLESSYFEKIESNALRAFIKICPRNGLLYNAIYRNSKNYLNNIDLEDKKTTSK TNVSYPCSLLNGCIEVENKDLFLISNKDSLNDINLSEEKIKPETTVFFKDKLPPQDIT LSNYDFTEANSIPSISQQNILERNEELYEPIRNSLFEIKTIYVDKLTTFHFLEAQNIDE SIDSSKIRVELTDSVDEALSNPNKVYSPFKNMSNTINSIETGITSTYIFYQWLRSIVK DFSDETGKIDVIDKSSDTLAIVPYIGPLLNIGNDIRHGDFVGAIELAGITALLEYVPE FTIPILVGLEVIGGELAREQVEAIVNNALDKRDQKWAEVYNITKAQWWGTIHLQI NTRLAHTYKALSRQANAIKMNMEFQLANYKGNIDDKAKIKNAISETEILLNKSVE QAMKNTEKFMIKLSNSYLTKEMIPKVQDNLKNFDLETKKTLDKFIKEKEDILGTN LSSSLRRKVSIRLNKNIAFDINDIPFSEFDDLINQYKNEIEDYEVLNLGAEDGKIKD LSGTTSDINIGSDIELADGRENKAIKIKGSENSTIKIAMNKYLRFSATDNFSISFWIK HPKPTNLLNNGIEYTLVENFNQRGWKISIQDSKLIWYLRDHNNSIKIVTPDYIAFN GWNLITITNNRSKGSIVYVNGSKIEEKDISSIWNTEVDDPIIFRLKNNRDTQAFTLL |

TABLE 1-continued

Exemplary, non-limiting BoNT amino acid sequences

| SEQ ID NO | Description | Sequence |
|---|---|---|
| | | DQFSIYRKELNQNEVVKLYNYYFNSNYIRDIWGNPLQYNKKYYLQTQDKPGKGL<br>IREYWSSFGYDYVILSDSKTITFPNNIRYGALYNGSKVLIKNSKKLDGLVRNKDFI<br>QLEIDGYNMGISADRFNEDTNYIGTTYGTTHDLTTDFEIIQRQEKYRNYCQLKTP<br>YNIFHKSGLMSTETSKPTFHDYRDWVYSSAWYFQNYENLNLRKHTKTNWYFIPK<br>DEGWDED |
| 59 | WT<br>BoNT/X<br>LC-$H_N$ | MKLEINKFNYNDPIDGINVITMRPPRHSDKINKGKGPFKAFQVIKNIWIVPERYNF<br>TNNTNDLNIPSEPIMEADAIYNPNYLNTPSEKDEFLQGVIKVLERIKSKPEGEKLLE<br>LISSSIPLPLVSNGALTLSDNETIAYQENNNIVSNLQANLVIYGPGPDIANNATYGL<br>YSTPISNGEGTLSEVSFSPFYLKPFDESYGNYRSLVNIVNKFVKREFAPDPASTLM<br>HELVHVTHNLYGISNRNFYYNFDTGKIETSRQQNSLIFEELLTFGGIDSKAISSLII<br>KKIIETAKNNYTTLISERLNTVTVENDLLKYIKNKIPVQGRLGNFKLDTAEFEKKL<br>NTILFVLNESNLAQRFSILVRKHYLKERPIDPIYVNILDDNSYSTLEGFNISSQGSND<br>FQGQLLESSYFEKIESNALRAFIKICPRNGLLYNAIYRNSKNYLNNIDLEDKKTTSK<br>TNVSYPCSLLNGCIEVENKDLFLISNKDSLNDINLSEEKIKPETTVFFKDKLPPQDIT<br>LSNYDFTEANSIPSISQQNILERNEELYEPIRNSLFEIKTIYVDKLTTFHFLEAQNIDE<br>SIDSSKIRVELTDSVDEALSNPNKVYSPFKNMSNTINSIETGITSTYIFYQWLRSIVK<br>DFSDETGKIDVIDKSSDTLAIVPYIGPLLNIGNDIRHGDFVGAIELAGITALLEYVPE<br>FTIPILVGLEVIGGELAREQVEAIVNNALDKRDQKWAEVYNITKAQWWGTIHLQI<br>NTRLAHTYKALSRQANAIKMNMEFQLANYKGNIDDKAKIKNAISETEILLNKSVE<br>QAMKNTEKFMIKLSNSYLTKEMIPKVQDNLKNFDLETKKTLDKFIKEKEDILGTN<br>LSSSLRRKVSIRLNKNIAFDINDIPFSEFDDLINQYKNEI |
| 60 | WT<br>BoNT/X<br>LC | MKLEINKFNYNDPIDGINVITMRPPRHSDKINKGKGPFKAFQVIKNIWIVPERYNF<br>TNNTNDLNIPSEPIMEADAIYNPNYLNTPSEKDEFLQGVIKVLERIKSKPEGEKLLE<br>LISSSIPLPLVSNGALTLSDNETIAYQENNNIVSNLQANLVIYGPGPDIANNATYGL<br>YSTPISNGEGTLSEVSFSPFYLKPFDESYGNYRSLVNIVNKFVKREFAPDPASTLM<br>HELVHVTHNLYGISNRNFYYNFDTGKIETSRQQNSLIFEELLTFGGIDSKAISSLIIK<br>KIIETAKNNYTTLISERLNTVTVENDLLKYIKNKIPVQGRLGNFKLDTAEFEKKLN<br>TILFVLNESNLAQRFSILVRKHYLKERPIDPIYVNILDDNSYSTLEGFNISSQGSNDF<br>QGQLLESSYFEKIESNALRAFIKICPRNGLLYNAIYRNSKN |
| 61 | WT<br>BoNT/X<br>C461S | MKLEINKFNYNDPIDGINVITMRPPRHSDKINKGKGPFKAFQVIKNIWIVPERYNF<br>TNNTNDLNIPSEPIMEADAIYNPNYLNTPSEKDEFLQGVIKVLERIKSKPEGEKLLE<br>LISSSIPLPLVSNGALTLSDNETIAYQENNNIVSNLQANLVIYGPGPDIANNATYGL<br>YSTPISNGEGTLSEVSFSPFYLKPFDESYGNYRSLVNIVNKFVKREFAPDPASTLM<br>HELVHVTHNLYGISNRNFYYNFDTGKIETSRQQNSLIFEELLTFGGIDSKAISSLIIK<br>KIIETAKNNYTTLISERLNTVTVENDLLKYIKNKIPVQGRLGNFKLDTAEFEKKLN<br>TILFVLNESNLAQRFSILVRKHYLKERPIDPIYVNILDDNSYSTLEGFNISSQGSNDF<br>QGQLLESSYFEKIESNALRAFIKICPRNGLLYNAIYRNSKNYLNNIDLEDKKTTSK<br>TNVSYPSSLLNGCIEVENKDLFLISNKDSLNDINLSEEKIKPETTVFFKDKLPPQDIT<br>LSNYDFTEANSIPSISQQNILERNEELYEPIRNSLFEIKTIYVDKLTTFHFLEAQNIDE<br>SIDSSKIRVELTDSVDEALSNPNKVYSPFKNMSNTINSIETGITSTYIFYQWLRSIVK<br>DFSDETGKIDVIDKSSDTLAIVPYIGPLLNIGNDIRHGDFVGAIELAGITALLEYVPE<br>FTIPILVGLEVIGGELAREQVEAIVNNALDKRDQKWAEVYNITKAQWWGTIHLQI<br>NTRLAHTYKALSRQANAIKMNMEFQLANYKGNIDDKAKIKNAISETEILLNKSVE<br>QAMKNTEKFMIKLSNSYLTKEMIPKVQDNLKNFDLETKKTLDKFIKEKEDILGTN<br>LSSSLRRKVSIRLNKNIAFDINDIPFSEFDDLINQYKNEIEDYEVLNLGAEDGKIKD<br>LSGTTSDINIGSDIELADGRENKAIKIKGSENSTIKIAMNKYLRFSATDNFSISFWIK<br>HPKPTNLLNNGIEYTLVENFNQRGWKISIQDSKLIWYLRDHNNSIKIVTPDYIAFN<br>GWNLITITNNRSKGSIVYVNGSKIEEKDISSIWNTEVDDPIIFRLKNNRDTQAFTLL<br>DQFSIYRKELNQNEVVKLYNYYFNSNYIRDIWGNPLQYNKKYYLQTQDKPGKGL<br>IREYWSSFGYDYVILSDSKTITFPNNIRYGALYNGSKVLIKNSKKLDGLVRNKDFI<br>QLEIDGYNMGISADRFNEDTNYIGTTYGTTHDLTTDFEIIQRQEKYRNYCQLKTP<br>YNIFHKSGLMSTETSKPTFHDYRDWVYSSAWYFQNYENLNLRKHTKTNWYFIPK<br>DEGWDED |
| 62 | WT<br>BoNT/X<br>C461A | MKLEINKFNYNDPIDGINVITMRPPRHSDKINKGKGPFKAFQVIKNIWIVPERYNF<br>TNNTNDLNIPSEPIMEADAIYNPNYLNTPSEKDEFLQGVIKVLERIKSKPEGEKLLE<br>LISSSIPLPLVSNGALTLSDNETIAYQENNNIVSNLQANLVIYGPGPDIANNATYGL<br>YSTPISNGEGTLSEVSFSPFYLKPFDESYGNYRSLVNIVNKFVKREFAPDPASTLM<br>HELVHVTHNLYGISNRNFYYNFDTGKIETSRQQNSLIFEELLTFGGIDSKAISSLIIK<br>KIIETAKNNYTTLISERLNTVTVENDLLKYIKNKIPVQGRLGNFKLDTAEFEKKLN<br>TILFVLNESNLAQRFSILVRKHYLKERPIDPIYVNILDDNSYSTLEGFNISSQGSNDF<br>QGQLLESSYFEKIESNALRAFIKICPRNGLLYNAIYRNSKNYLNNIDLEDKKTTSK<br>TNVSYPASLLNGCIEVENKDLFLISNKDSLNDINLSEEKIKPETTVFFKDKLPPQDI<br>TLSNYDFTEANSIPSISQQNILERNEELYEPIRNSLFEIKTIYVDKLTTFHFLEAQNID<br>ESIDSSKIRVELTDSVDEALSNPNKVYSPFKNMSNTINSIETGITSTYIFYQWLRSIV<br>KDFSDETGKIDVIDKSSDTLAIVPYIGPLLNIGNDIRHGDFVGAIELAGITALLEYVP<br>EFTIPILVGLEVIGGELAREQVEAIVNNALDKRDQKWAEVYNITKAQWWGTIHLQ<br>INTRLAHTYKALSRQANAIKMNMEFQLANYKGNIDDKAKIKNAISETEILLNKSV<br>EQAMKNTEKFMIKLSNSYLTKEMIPKVQDNLKNFDLETKKTLDKFIKEKEDILGT<br>NLSSSLRRKVSIRLNKNIAFDINDIPFSEFDDLINQYKNEIEDYEVLNLGAEDGKIK<br>DLSGTTSDINIGSDIELADGRENKAIKIKGSENSTIKIAMNKYLRFSATDNFSISFWI |

TABLE 1-continued

Exemplary, non-limiting BoNT amino acid sequences

| SEQ ID NO | Description | Sequence |
|---|---|---|
| | | KHPKPTNLLNNGIEYTLVENFNQRGWKISIQDSKLIWYLRDHNNSIKIVTPDYIAF<br>NGWNLITITNNRSKGSIVYVNGSKIEEKDISSIWNTEVDDPIIFRLKNNRDTQAFTL<br>LDQFSIYRKELNQNEVVKLYNYYFNSNYIRDIWGNPLQYNKKYYLQTQDKPGKG<br>LIREYWSSFGYDYVILSDSKTITFPNNIRYGALYNGSKVLIKNSKKLDGLVRNKDF<br>IQLEIDGYNMGISADRFNEDTNYIGTTYGTTHDLTTDFEIIQRQEKYRNYCQLKTP<br>YNIFHKSGLMSTETSKPTFHDYRDWVYSSAWYFQNYENLNLRKHTKTNWYFIPK<br>DEGWDED |
| 63 | WT BoNT/X C467S | MKLEINKFNYNDPIDGINVITMRPPRHSDKINKGKGPFKAFQVIKNIWIVPERYNF<br>TNNTNDLNIPSEPIMEADAIYNPNYLNTPSEKDEFLQGVIKVLERIKSKPEGEKLLE<br>LISSSIPLPLVSNGALTLSDNETIAYQENNNIVSNLQANLVIYGPGPDIANNATYGL<br>YSTPISNGEGTLSEVSFSPFYLKPFDESYGNYRSLVNIVNKFVKREFAPDPASTLM<br>HELVHVTHNLYGISNRNFYYNFDTGKIETSRQQNSLIFEELLTFGGIDSKAISSLIIK<br>KIIETAKNNYTTLISERLNTVTVENDLLKYIKNKIPVQGRLGNFKLDTAEFEKKLN<br>TILFVLNESNLAQRFSILVRKHYLKERPIDPIYVNILDDNSYSTLEGFNISSQGSNDF<br>QGQLLESSYFEKIESNALRAFIKICPRNGLLYNAIYRNSKNYLNNIDLEDKKTTSK<br>TNVSYPCSLLNGSIEVENKDLFLISNKDSLNDINLSEEKIKPETTVFFKDKLPPQDIT<br>LSNYDFTEANSIPSISQQNILERNEELYEPIRNSLFEIKTIYVDKLTTFHFLEAQNIDE<br>SIDSSKIRVELTDSVDEALSNPNKVYSPFKNMSNTINSIETGITSTYIFYQWLRSIVK<br>DFSDETGKIDVIDKSSDTLAIVPYIGPLLNIGNDIRHGDFVGAIELAGITALLEYVPE<br>FTIPILVGLEVIGGELAREQVEAIVNNALDKRDQKWAEVYNITKAQWWGTIHLQI<br>NTRLAHTYKALSRQANAIKMNMEFQLANYKGNIDDKAKIKNAISETEILLNKSVE<br>QAMKNTEKFMIKLSNSYLTKEMIPKVQDNLKNFDLETKKTLDKFIKEKEDILGTN<br>LSSSLRRKVSIRLNKNIAFDINDIPFSEFDDLINQYKNEIEDYEVLNLGAEDGKIKD<br>LSGTTSDINIGSDIELADGRENKAIKIKGSENSTIKIAMNKYLRFSATDNFSISFWIK<br>HPKPTNLLNNGIEYTLVENFNQRGWKISIQDSKLIWYLRDHNNSIKIVTPDYIAFN<br>GWNLITITNNRSKGSIVYVNGSKIEEKDISSIWNTEVDDPIIFRLKNNRDTQAFTLL<br>DQFSIYRKELNQNEVVKLYNYYFNSNYIRDIWGNPLQYNKKYYLQTQDKPGKGL<br>IREYWSSFGYDYVILSDSKTITFPNNIRYGALYNGSKVLIKNSKKLDGLVRNKDFI<br>QLEIDGYNMGISADRFNEDTNYIGTTYGTTHDLTTDFEIIQRQEKYRNYCQLKTP<br>YNIFHKSGLMSTETSKPTFHDYRDWVYSSAWYFQNYENLNLRKHTKTNWYFIPK<br>DEGWDED |
| 64 | WT BoNT/X C467A | MKLEINKFNYNDPIDGINVITMRPPRHSDKINKGKGPFKAFQVIKNIWIVPERYNF<br>TNNTNDLNIPSEPIMEADAIYNPNYLNTPSEKDEFLQGVIKVLERIKSKPEGEKLLE<br>LISSSIPLPLVSNGALTLSDNETIAYQENNNIVSNLQANLVIYGPGPDIANNATYGL<br>YSTPISNGEGTLSEVSFSPFYLKPFDESYGNYRSLVNIVNKFVKREFAPDPASTLM<br>HELVHVTHNLYGISNRNFYYNFDTGKIETSRQQNSLIFEELLTFGGIDSKAISSLIIK<br>KIIETAKNNYTTLISERLNTVTVENDLLKYIKNKIPVQGRLGNFKLDTAEFEKKLN<br>TILFVLNESNLAQRFSILVRKHYLKERPIDPIYVNILDDNSYSTLEGFNISSQGSNDF<br>QGQLLESSYFEKIESNALRAFIKICPRNGLLYNAIYRNSKNYLNNIDLEDKKTTSK<br>TNVSYPCSLLNGAIEVENKDLFLISNKDSLNDINLSEEKIKPETTVFFKDKLPPQDI<br>TLSNYDFTEANSIPSISQQNILERNEELYEPIRNSLFEIKTIYVDKLTTFHFLEAQNID<br>ESIDSSKIRVELTDSVDEALSNPNKVYSPFKNMSNTINSIETGITSTYIFYQWLRSIV<br>KDFSDETGKIDVIDKSSDTLAIVPYIGPLLNIGNDIRHGDFVGAIELAGITALLEYVP<br>EFTIPILVGLEVIGGELAREQVEAIVNNALDKRDQKWAEVYNITKAQWWGTIHLQ<br>INTRLAHTYKALSRQANAIKMNMEFQLANYKGNIDDKAKIKNAISETEILLNKSV<br>EQAMKNTEKFMIKLSNSYLTKEMIPKVQDNLKNFDLETKKTLDKFIKEKEDILGT<br>NLSSSLRRKVSIRLNKNIAFDINDIPFSEFDDLINQYKNEIEDYEVLNLGAEDGKIK<br>DLSGTTSDINIGSDIELADGRENKAIKIKGSENSTIKIAMNKYLRFSATDNFSISFWI<br>KHPKPTNLLNNGIEYTLVENFNQRGWKISIQDSKLIWYLRDHNNSIKIVTPDYIAF<br>NGWNLITITNNRSKGSIVYVNGSKIEEKDISSIWNTEVDDPIIFRLKNNRDTQAFTL<br>LDQFSIYRKELNQNEVVKLYNYYFNSNYIRDIWGNPLQYNKKYYLQTQDKPGKG<br>LIREYWSSFGYDYVILSDSKTITFPNNIRYGALYNGSKVLIKNSKKLDGLVRNKDF<br>IQLEIDGYNMGISADRFNEDTNYIGTTYGTTHDLTTDFEIIQRQEKYRNYCQLKTP<br>YNIFHKSGLMSTETSKPTFHDYRDWVYSSAWYFQNYENLNLRKHTKTNWYFIPK<br>DEGWDED |
| 65 | WT BoNT/X C1240S | MKLEINKFNYNDPIDGINVITMRPPRHSDKINKGKGPFKAFQVIKNIWIVPERYNF<br>TNNTNDLNIPSEPIMEADAIYNPNYLNTPSEKDEFLQGVIKVLERIKSKPEGEKLLE<br>LISSSIPLPLVSNGALTLSDNETIAYQENNNIVSNLQANLVIYGPGPDIANNATYGL<br>YSTPISNGEGTLSEVSFSPFYLKPFDESYGNYRSLVNIVNKFVKREFAPDPASTLM<br>HELVHVTHNLYGISNRNFYYNFDTGKIETSRQQNSLIFEELLTFGGIDSKAISSLIIK<br>KIIETAKNNYTTLISERLNTVTVENDLLKYIKNKIPVQGRLGNFKLDTAEFEKKLN<br>TILFVLNESNLAQRFSILVRKHYLKERPIDPIYVNILDDNSYSTLEGFNISSQGSNDF<br>QGQLLESSYFEKIESNALRAFIKICPRNGLLYNAIYRNSKNYLNNIDLEDKKTTSK<br>TNVSYPCSLLNGCIEVENKDLFLISNKDSLNDINLSEEKIKPETTVFFKDKLPPQDIT<br>LSNYDFTEANSIPSISQQNILERNEELYEPIRNSLFEIKTIYVDKLTTFHFLEAQNIDE<br>SIDSSKIRVELTDSVDEALSNPNKVYSPFKNMSNTINSIETGITSTYIFYQWLRSIVK<br>DFSDETGKIDVIDKSSDTLAIVPYIGPLLNIGNDIRHGDFVGAIELAGITALLEYVPE<br>FTIPILVGLEVIGGELAREQVEAIVNNALDKRDQKWAEVYNITKAQWWGTIHLQI<br>NTRLAHTYKALSRQANAIKMNMEFQLANYKGNIDDKAKIKNAISETEILLNKSVE<br>QAMKNTEKFMIKLSNSYLTKEMIPKVQDNLKNFDLETKKTLDKFIKEKEDILGTN<br>LSSSLRRKVSIRLNKNIAFDINDIPFSEFDDLINQYKNEIEDYEVLNLGAEDGKIKD |

TABLE 1-continued

Exemplary, non-limiting BoNT amino acid sequences

| SEQ ID NO | Description | Sequence |
|---|---|---|
| | | LSGTTSDINIGSDIELADGRENKAIKIKGSENSTIKIAMNKYLRFSATDNFSISFWIK<br>HPKPTNLLNNGIEYTLVENFNQRGWKISIQDSKLIWYLRDHNNSIKIVTPDYIAFN<br>GWNLITITNNRSKGSIVYVNGSKIEEKDISSIWNTEVDDPIIFRLKNNRDTQAFTLL<br>DQFSIYRKELNQNEVVKLYNYYFNSNYIRDIWGNPLQYNKKYYLQTQDKPGKGL<br>IREYWSSFGYDYVILSDSKTITFPNNIRYGALYNGSKVLIKNSKKLDGLVRNKDFI<br>QLEIDGYNMGISADRFNEDTNYIGTTYGTTHDLTTDFEIIQRQEKYRNYSQLKTPY<br>NIFHKSGLMSTETSKPTFHDYRDWVYSSAWYFQNYENLNLRKHTKTNWYFIPKD<br>EGWDED |
| 66 | WT<br>BoNT/X<br>C1240S | MKLEINKFNYNDPIDGINVITMRPPRHSDKINKGKGPFKAFQVIKNIWIVPERYNF<br>TNNTNDLNIPSEPIMEADAIYNPNYLNTPSEKDEFLQGVIKVLERIKSKPEGEKLLE<br>LISSSIPLPLVSNGALTLSDNETIAYQENNNIVSNLQANLVIYGPGPDIANNATYGL<br>YSTPISNGEGTLSEVSFSPFYLKPFDESYGNYRSLVNIVNKFVKREFAPDPASTLM<br>HELVHVTHNLYGISNRNFYYNFDTGKIETSRQQNSLIFEELLTFGGIDSKAISSLIIK<br>KIIETAKNNYTTLISERLNTVTVENDLLKYIKNKIPVQGRLGNFKLDTAEFEKKLN<br>TILFVLNESNLAQRFSILVRKHYLKERPIDPIYVNILDDNSYSTLEGFNISSQGSNDF<br>QGQLLESSYFEKIESNALRAFIKICPRNGLLYNAIYRNSKNYLNNIDLEDKKTTSK<br>TNVSYPCSLLNGCIEVENKDLFLISNKDSLNDINLSEEKIKPETTVFFKDKLPPQDIT<br>LSNYDFTEANSIPSISQQNILERNEELYEPIRNSLFEIKTIYVDKLTTFHFLEAQNIDE<br>SIDSSKIRVELTDSVDEALSNPNKVYSPFKNMSNTINSIETGITSTYIFYQWLRSIVK<br>DFSDETGKIDVIDKSSDTLAIVPYIGPLLNIGNDIRHGDFVGAIELAGITALLEYVPE<br>FTIPILVGLEVIGGELAREQVEAIVNNALDKRDQKWAEVYNITKAQWWGTIHLQI<br>NTRLAHTYKALSRQANAIKMNMEFQLANYKGNIDDKAKIKNAISETEILLNKSVE<br>QAMKNTEKFMIKLSNSYLTKEMIPKVQDNLKNFDLETKKTLDKFIKEKEDILGTN<br>LSSSLRRKVSIRLNKNIAFDINDIPFSEFDDLINQYKNEIEDYEVLNLGAEDGKIKD<br>LSGTTSDINIGSDIELADGRENKAIKIKGSENSTIKIAMNKYLRFSATDNFSISFWIK<br>HPKPTNLLNNGIEYTLVENFNQRGWKISIQDSKLIWYLRDHNNSIKIVTPDYIAFN<br>GWNLITITNNRSKGSIVYVNGSKIEEKDISSIWNTEVDDPIIFRLKNNRDTQAFTLL<br>DQFSIYRKELNQNEVVKLYNYYFNSNYIRDIWGNPLQYNKKYYLQTQDKPGKGL<br>IREYWSSFGYDYVILSDSKTITFPNNIRYGALYNGSKVLIKNSKKLDGLVRNKDFI<br>QLEIDGYNMGISADRFNEDTNYIGTTYGTTHDLTTDFEIIQRQEKYRNYAQLKTP<br>YNIFHKSGLMSTETSKPTFHDYRDWVYSSAWYFQNYENLNLRKHTKTNWYFIPK<br>DEGWDED |
| 67 | WT<br>BoNT/X<br>C461S/C124<br>0A | MKLEINKFNYNDPIDGINVITMRPPRHSDKINKGKGPFKAFQVIKNIWIVPERYNF<br>TNNTNDLNIPSEPIMEADAIYNPNYLNTPSEKDEFLQGVIKVLERIKSKPEGEKLLE<br>LISSSIPLPLVSNGALTLSDNETIAYQENNNIVSNLQANLVIYGPGPDIANNATYGL<br>YSTPISNGEGTLSEVSFSPFYLKPFDESYGNYRSLVNIVNKFVKREFAPDPASTLM<br>HELVHVTHNLYGISNRNFYYNFDTGKIETSRQQNSLIFEELLTFGGIDSKAISSLIIK<br>KIIETAKNNYTTLISERLNTVTVENDLLKYIKNKIPVQGRLGNFKLDTAEFEKKLN<br>TILFVLNESNLAQRFSILVRKHYLKERPIDPIYVNILDDNSYSTLEGFNISSQGSNDF<br>QGQLLESSYFEKIESNALRAFIKICPRNGLLYNAIYRNSKNYLNNIDLEDKKTTSK<br>TNVSYPSSLLNGCIEVENKDLFLISNKDSLNDINLSEEKIKPETTVFFKDKLPPQDIT<br>LSNYDFTEANSIPSISQQNILERNEELYEPIRNSLFEIKTIYVDKLTTFHFLEAQNIDE<br>SIDSSKIRVELTDSVDEALSNPNKVYSPFKNMSNTINSIETGITSTYIFYQWLRSIVK<br>DFSDETGKIDVIDKSSDTLAIVPYIGPLLNIGNDIRHGDFVGAIELAGITALLEYVPE<br>FTIPILVGLEVIGGELAREQVEAIVNNALDKRDQKWAEVYNITKAQWWGTIHLQI<br>NTRLAHTYKALSRQANAIKMNMEFQLANYKGNIDDKAKIKNAISETEILLNKSVE<br>QAMKNTEKFMIKLSNSYLTKEMIPKVQDNLKNFDLETKKTLDKFIKEKEDILGTN<br>LSSSLRRKVSIRLNKNIAFDINDIPFSEFDDLINQYKNEIEDYEVLNLGAEDGKIKD<br>LSGTTSDINIGSDIELADGRENKAIKIKGSENSTIKIAMNKYLRFSATDNFSISFWIK<br>HPKPTNLLNNGIEYTLVENFNQRGWKISIQDSKLIWYLRDHNNSIKIVTPDYIAFN<br>GWNLITITNNRSKGSIVYVNGSKIEEKDISSIWNTEVDDPIIFRLKNNRDTQAFTLL<br>DQFSIYRKELNQNEVVKLYNYYFNSNYIRDIWGNPLQYNKKYYLQTQDKPGKGL<br>IREYWSSFGYDYVILSDSKTITFPNNIRYGALYNGSKVLIKNSKKLDGLVRNKDFI<br>QLEIDGYNMGISADRFNEDTNYIGTTYGTTHDLTTDFEIIQRQEKYRNYAQLKTP<br>YNIFHKSGLMSTETSKPTFHDYRDWVYSSAWYFQNYENLNLRKHTKTNWYFIPK<br>DEGWDED |
| 68 | WT<br>BoNT/X<br>C4615/C124<br>0S | MKLEINKFNYNDPIDGINVITMRPPRHSDKINKGKGPFKAFQVIKNIWIVPERYNF<br>TNNTNDLNIPSEPIMEADAIYNPNYLNTPSEKDEFLQGVIKVLERIKSKPEGEKLLE<br>LISSSIPLPLVSNGALTLSDNETIAYQENNNIVSNLQANLVIYGPGPDIANNATYGL<br>YSTPISNGEGTLSEVSFSPFYLKPFDESYGNYRSLVNIVNKFVKREFAPDPASTLM<br>HELVHVTHNLYGISNRNFYYNFDTGKIETSRQQNSLIFEELLTFGGIDSKAISSLIIK<br>KIIETAKNNYTTLISERLNTVTVENDLLKYIKNKIPVQGRLGNFKLDTAEFEKKLN<br>TILFVLNESNLAQRFSILVRKHYLKERPIDPIYVNILDDNSYSTLEGFNISSQGSNDF<br>QGQLLESSYFEKIESNALRAFIKICPRNGLLYNAIYRNSKNYLNNIDLEDKKTTSK<br>TNVSYPSSLLNGCIEVENKDLFLISNKDSLNDINLSEEKIKPETTVFFKDKLPPQDIT<br>LSNYDFTEANSIPSISQQNILERNEELYEPIRNSLFEIKTIYVDKLTTFHFLEAQNIDE<br>SIDSSKIRVELTDSVDEALSNPNKVYSPFKNMSNTINSIETGITSTYIFYQWLRSIVK<br>DFSDETGKIDVIDKSSDTLAIVPYIGPLLNIGNDIRHGDFVGAIELAGITALLEYVPE<br>FTIPILVGLEVIGGELAREQVEAIVNNALDKRDQKWAEVYNITKAQWWGTIHLQI<br>NTRLAHTYKALSRQANAIKMNMEFQLANYKGNIDDKAKIKNAISETEILLNKSVE<br>QAMKNTEKFMIKLSNSYLTKEMIPKVQDNLKNFDLETKKTLDKFIKEKEDILGTN |

TABLE 1-continued

Exemplary, non-limiting BoNT amino acid sequences

| SEQ ID NO | Description | Sequence |
|---|---|---|
| | | LSSSLRRKVSIRLNKNIAFDINDIPFSEFDDLINQYKNEIEDYEVLNLGAEDGKIKD<br>LSGTTSDINIGSDIELADGRENKAIKIKGSENSTIKIAMNKYLRFSATDNFSISFWIK<br>HPKPTNLLNNGIEYTLVENFNQRGWKISIQDSKLIWYLRDHNNSIKIVTPDYIAFN<br>GWNLITITNNRSKGSIVYVNGSKIEEKDISSIWNTEVDDPIIFRLKNNRDTQAFTLL<br>DQFSIYRKELNQNEVVKLYNYYFNSNYIRDIWGNPLQYNKKYYLQTQDKPGKGL<br>IREYWSSFGYDYVILSDSKTITFPNNIRYGALYNGSKVLIKNSKKLDGLVRNKDFI<br>QLEIDGYNMGISADRFNEDTNYIGTTYGTTHDLTTDFEIIQRQEKYRNYSQLKTPY<br>NIFHKSGLMSTETSKPTFHDYRDWVYSSAWYFQNYENLNLRKHTKTNWYFIPKD<br>EGWDED |
| 69 | WT<br>BoNT/X<br>C461A/C12<br>40S | MKLEINKFNYNDPIDGINVITMRPPRHSDKINKGKGPFKAFQVIKNIWIVPERYNF<br>TNNTNDLNIPSEPIMEADAIYNPNYLNTPSEKDEFLQGVIKVLERIKSKPEGEKLLE<br>LISSSIPLPLVSNGALTLSDNETIAYQENNNIVSNLQANLVIYGPGPDIANNATYGL<br>YSTPISNGEGTLSEVSFSPFYLKPFDESYGNYRSLVNIVNKFVKREFAPDPASTLM<br>HELVHVTHNLYGISNRNFYYNFDTGKIETSRQQNSLIFEELLTFGGIDSKAISSLIIK<br>KIIETAKNNYTTLISERLNTVTVENDLLKYIKNKIPVQGRLGNFKLDTAEFEKKLN<br>TILFVLNESNLAQRFSILVRKHYLKERPIDPIYVNILDDNSYSTLEGFNISSQGSNDF<br>QGQLLESSYFEKIESNALRAFIKICPRNGLLYNAIYRNSKNYLNNIDLEDKKTTSK<br>TNVSYPASLLNGCIEVENKDLFLISNKDSLNDINLSEEKIKPETTVFFKDKLPPQDI<br>TLSNYDFTEANSIPSISQQNILERNEELYEPIRNSLFEIKTIYVDKLTTFHFLEAQNID<br>ESIDSSKIRVELTDSVDEALSNPNKVYSPFKNMSNTINSIETGITSTYIFYQWLRSIV<br>KDFSDETGKIDVIDKSSDTLAIVPYIGPLLNIGNDIRHGDFVGAIELAGITALLEYVP<br>EFTIPILVGLEVIGGELAREQVEAIVNNALDKRDQKWAEVYNITKAQWWGTIHLQ<br>INTRLAHTYKALSRQANAIKMNMEFQLANYKGNIDDKAKIKNAISETEILLNKSV<br>EQAMKNTEKFMIKLSNSYLTKEMIPKVQDNLKNFDLETKKTLDKFIKEKEDILGT<br>NLSSSLRRKVSIRLNKNIAFDINDIPFSEFDDLINQYKNEIEDYEVLNLGAEDGKIK<br>DLSGTTSDINIGSDIELADGRENKAIKIKGSENSTIKIAMNKYLRFSATDNFSISFWI<br>KHPKPTNLLNNGIEYTLVENFNQRGWKISIQDSKLIWYLRDHNNSIKIVTPDYIAF<br>NGWNLITITNNRSKGSIVYVNGSKIEEKDISSIWNTEVDDPIIFRLKNNRDTQAFTL<br>LDQFSIYRKELNQNEVVKLYNYYFNSNYIRDIWGNPLQYNKKYYLQTQDKPGKG<br>LIREYWSSFGYDYVILSDSKTITFPNNIRYGALYNGSKVLIKNSKKLDGLVRNKDF<br>IQLEIDGYNMGISADRFNEDTNYIGTTYGTTHDLTTDFEIIQRQEKYRNYSQLKTP<br>YNIFHKSGLMSTETSKPTFHDYRDWVYSSAWYFQNYENLNLRKHTKTNWYFIPK<br>DEGWDED |
| 70 | WT<br>BoNT/X<br>C461A/C12<br>40A | MKLEINKFNYNDPIDGINVITMRPPRHSDKINKGKGPFKAFQVIKNIWIVPERYNF<br>TNNTNDLNIPSEPIMEADAIYNPNYLNTPSEKDEFLQGVIKVLERIKSKPEGEKLLE<br>LISSSIPLPLVSNGALTLSDNETIAYQENNNIVSNLQANLVIYGPGPDIANNATYGL<br>YSTPISNGEGTLSEVSFSPFYLKPFDESYGNYRSLVNIVNKFVKREFAPDPASTLM<br>HELVHVTHNLYGISNRNFYYNFDTGKIETSRQQNSLIFEELLTFGGIDSKAISSLIIK<br>KIIETAKNNYTTLISERLNTVTVENDLLKYIKNKIPVQGRLGNFKLDTAEFEKKLN<br>TILFVLNESNLAQRFSILVRKHYLKERPIDPIYVNILDDNSYSTLEGFNISSQGSNDF<br>QGQLLESSYFEKIESNALRAFIKICPRNGLLYNAIYRNSKNYLNNIDLEDKKTTSK<br>TNVSYPASLLNGCIEVENKDLFLISNKDSLNDINLSEEKIKPETTVFFKDKLPPQDI<br>TLSNYDFTEANSIPSISQQNILERNEELYEPIRNSLFEIKTIYVDKLTTFHFLEAQNID<br>ESIDSSKIRVELTDSVDEALSNPNKVYSPFKNMSNTINSIETGITSTYIFYQWLRSIV<br>KDFSDETGKIDVIDKSSDTLAIVPYIGPLLNIGNDIRHGDFVGAIELAGITALLEYVP<br>EFTIPILVGLEVIGGELAREQVEAIVNNALDKRDQKWAEVYNITKAQWWGTIHLQ<br>INTRLAHTYKALSRQANAIKMNMEFQLANYKGNIDDKAKIKNAISETEILLNKSV<br>EQAMKNTEKFMIKLSNSYLTKEMIPKVQDNLKNFDLETKKTLDKFIKEKEDILGT<br>NLSSSLRRKVSIRLNKNIAFDINDIPFSEFDDLINQYKNEIEDYEVLNLGAEDGKIK<br>DLSGTTSDINIGSDIELADGRENKAIKIKGSENSTIKIAMNKYLRFSATDNFSISFWI<br>KHPKPTNLLNNGIEYTLVENFNQRGWKISIQDSKLIWYLRDHNNSIKIVTPDYIAF<br>NGWNLITITNNRSKGSIVYVNGSKIEEKDISSIWNTEVDDPIIFRLKNNRDTQAFTL<br>LDQFSIYRKELNQNEVVKLYNYYFNSNYIRDIWGNPLQYNKKYYLQTQDKPGKG<br>LIREYWSSFGYDYVILSDSKTITFPNNIRYGALYNGSKVLIKNSKKLDGLVRNKDF<br>IQLEIDGYNMGISADRFNEDTNYIGTTYGTTHDLTTDFEIIQRQEKYRNYAQLKTP<br>YNIFHKSGLMSTETSKPTFHDYRDWVYSSAWYFQNYENLNLRKHTKTNWYFIPK<br>DEGWDED |
| 71 | WT<br>BoNT/X<br>C4675/C124<br>0A | MKLEINKFNYNDPIDGINVITMRPPRHSDKINKGKGPFKAFQVIKNIWIVPERYNF<br>TNNTNDLNIPSEPIMEADAIYNPNYLNTPSEKDEFLQGVIKVLERIKSKPEGEKLLE<br>LISSSIPLPLVSNGALTLSDNETIAYQENNNIVSNLQANLVIYGPGPDIANNATYGL<br>YSTPISNGEGTLSEVSFSPFYLKPFDESYGNYRSLVNIVNKFVKREFAPDPASTLM<br>HELVHVTHNLYGISNRNFYYNFDTGKIETSRQQNSLIFEELLTFGGIDSKAISSLIIK<br>KIIETAKNNYTTLISERLNTVTVENDLLKYIKNKIPVQGRLGNFKLDTAEFEKKLN<br>TILFVLNESNLAQRFSILVRKHYLKERPIDPIYVNILDDNSYSTLEGFNISSQGSNDF<br>QGQLLESSYFEKIESNALRAFIKICPRNGLLYNAIYRNSKNYLNNIDLEDKKTTSK<br>TNVSYPCSLLNGSIEVENKDLFLISNKDSLNDINLSEEKIKPETTVFFKDKLPPQDIT<br>LSNYDFTEANSIPSISQQNILERNEELYEPIRNSLFEIKTIYVDKLTTFHFLEAQNIDE<br>SIDSSKIRVELTDSVDEALSNPNKVYSPFKNMSNTINSIETGITSTYIFYQWLRSIVK<br>DFSDETGKIDVIDKSSDTLAIVPYIGPLLNIGNDIRHGDFVGAIELAGITALLEYVPE<br>FTIPILVGLEVIGGELAREQVEAIVNNALDKRDQKWAEVYNITKAQWWGTIHLQI<br>NTRLAHTYKALSRQANAIKMNMEFQLANYKGNIDDKAKIKNAISETEILLNKSVE |

TABLE 1-continued

Exemplary, non-limiting BoNT amino acid sequences

| SEQ ID NO | Description | Sequence |
|---|---|---|
| | | QAMKNTEKFMIKLSNSYLTKEMIPKVQDNLKNFDLETKKTLDKFIKEKEDILGTN<br>LSSSLRRKVSIRLNKNIAFDINDIPFSEFDDLINQYKNEIEDYEVLNLGAEDGKIKD<br>LSGTTSDINIGSDIELADGRENKAIKIKGSENSTIKIAMNKYLRFSATDNFSISFWIK<br>HPKPTNLLNNGIEYTLVENFNQRGWKISIQDSKLIWYLRDHNNSIKIVTPDYIAFN<br>GWNLITITNNRSKGSIVYVNGSKIEEKDISSIWNTEVDDPIIFRLKNNRDTQAFTLL<br>DQFSIYRKELNQNEVVKLYNYYFNSNYIRDIWGNPLQYNKKYYLQTQDKPGKGL<br>IREYWSSFGYDYVILSDSKTITFPNNIRYGALYNGSKVLIKNSKKLDGLVRNKDFI<br>QLEIDGYNMGISADRFNEDTNYIGTTYGTTHDLTTDFEIIQRQEKYRNYAQLKTP<br>YNIFHKSGLMSTETSKPTFHDYRDWVYSSAWYFQNYENLNLRKHTKTNWYFIPK<br>DEGWDED |
| 72 | WT BoNT/X C467S/C1240S | MKLEINKFNYNDPIDGINVITMRPPRHSDKINKGKGPFKAFQVIKNIWIVPERYNF<br>TNNTNDLNIPSEPIMEADAIYNPNYLNTPSEKDEFLQGVIKVLERIKSKPEGEKLLE<br>LISSSIPLPLVSNGALTLSDNETIAYQENNNIVSNLQANLVIYGPGPDIANNATYGL<br>YSTPISNGEGTLSEVSFSPFYLKPFDESYGNYRSLVNIVNKFVKREFAPDPASTLM<br>HELVHVTHNLYGISNRNFYYNFDTGKIETSRQQNSLIFEELLTFGGIDSKAISSLIIK<br>KIIETAKNNYTTLISERLNTVTVENDLLKYIKNKIPVQGRLGNFKLDTAEFEKKLN<br>TILFVLNESNLAQRFSILVRKHYLKERPIDPIYVNILDDNSYSTLEGFNISSQGSNDF<br>QGQLLESSYFEKIESNALRAFIKICPRNGLLYNAIYRNSKNYLNNIDLEDKKTTSK<br>TNVSYPCSLLNGSIEVENKDLFLISNKDSLNDINLSEEKIKPETTVFFKDKLPPQDIT<br>LSNYDFTEANSIPSISQQNILERNEELYEPIRNSLFEIKTIYVDKLTTFHFLEAQNIDE<br>SIDSSKIRVELTDSVDEALSNPNKVYSPFKNMSNTINSIETGITSTYIFYQWLRSIVK<br>DFSDETGKIDVIDKSSDTLAIVPYIGPLLNIGNDIRHGDFVGAIELAGITALLEYVPE<br>FTIPILVGLEVIGGELAREQVEAIVNNALDKRDQKWAEVYNITKAQWWGTIHLQI<br>NTRLAHTYKALSRQANAIKMNMEFQLANYKGNIDDKAKIKNAISETEILLNKSVE<br>QAMKNTEKFMIKLSNSYLTKEMIPKVQDNLKNFDLETKKTLDKFIKEKEDILGTN<br>LSSSLRRKVSIRLNKNIAFDINDIPFSEFDDLINQYKNEIEDYEVLNLGAEDGKIKD<br>LSGTTSDINIGSDIELADGRENKAIKIKGSENSTIKIAMNKYLRFSATDNFSISFWIK<br>HPKPTNLLNNGIEYTLVENFNQRGWKISIQDSKLIWYLRDHNNSIKIVTPDYIAFN<br>GWNLITITNNRSKGSIVYVNGSKIEEKDISSIWNTEVDDPIIFRLKNNRDTQAFTLL<br>DQFSIYRKELNQNEVVKLYNYYFNSNYIRDIWGNPLQYNKKYYLQTQDKPGKGL<br>IREYWSSFGYDYVILSDSKTITFPNNIRYGALYNGSKVLIKNSKKLDGLVRNKDFI<br>QLEIDGYNMGISADRFNEDTNYIGTTYGTTHDLTTDFEIIQRQEKYRNYSQLKTPY<br>NIFHKSGLMSTETSKPTFHDYRDWVYSSAWYFQNYENLNLRKHTKTNWYFIPKD<br>EGWDED |
| 73 | WT BoNT/X C467A/C1240S | MKLEINKFNYNDPIDGINVITMRPPRHSDKINKGKGPFKAFQVIKNIWIVPERYNF<br>TNNTNDLNIPSEPIMEADAIYNPNYLNTPSEKDEFLQGVIKVLERIKSKPEGEKLLE<br>LISSSIPLPLVSNGALTLSDNETIAYQENNNIVSNLQANLVIYGPGPDIANNATYGL<br>YSTPISNGEGTLSEVSFSPFYLKPFDESYGNYRSLVNIVNKFVKREFAPDPASTLM<br>HELVHVTHNLYGISNRNFYYNFDTGKIETSRQQNSLIFEELLTFGGIDSKAISSLIIK<br>KIIETAKNNYTTLISERLNTVTVENDLLKYIKNKIPVQGRLGNFKLDTAEFEKKLN<br>TILFVLNESNLAQRFSILVRKHYLKERPIDPIYVNILDDNSYSTLEGFNISSQGSNDF<br>QGQLLESSYFEKIESNALRAFIKICPRNGLLYNAIYRNSKNYLNNIDLEDKKTTSK<br>TNVSYPCSLLNGAIEVENKDLFLISNKDSLNDINLSEEKIKPETTVFFKDKLPPQDI<br>TLSNYDFTEANSIPSISQQNILERNEELYEPIRNSLFEIKTIYVDKLTTFHFLEAQNID<br>ESIDSSKIRVELTDSVDEALSNPNKVYSPFKNMSNTINSIETGITSTYIFYQWLRSIV<br>KDFSDETGKIDVIDKSSDTLAIVPYIGPLLNIGNDIRHGDFVGAIELAGITALLEYVP<br>EFTIPILVGLEVIGGELAREQVEAIVNNALDKRDQKWAEVYNITKAQWWGTIHLQ<br>INTRLAHTYKALSRQANAIKMNMEFQLANYKGNIDDKAKIKNAISETEILLNKSV<br>EQAMKNTEKFMIKLSNSYLTKEMIPKVQDNLKNFDLETKKTLDKFIKEKEDILGT<br>NLSSSLRRKVSIRLNKNIAFDINDIPFSEFDDLINQYKNEIEDYEVLNLGAEDGKIK<br>DLSGTTSDINIGSDIELADGRENKAIKIKGSENSTIKIAMNKYLRFSATDNFSISFWI<br>KHPKPTNLLNNGIEYTLVENFNQRGWKISIQDSKLIWYLRDHNNSIKIVTPDYIAF<br>NGWNLITITNNRSKGSIVYVNGSKIEEKDISSIWNTEVDDPIIFRLKNNRDTQAFTL<br>LDQFSIYRKELNQNEVVKLYNYYFNSNYIRDIWGNPLQYNKKYYLQTQDKPGKG<br>LIREYWSSFGYDYVILSDSKTITFPNNIRYGALYNGSKVLIKNSKKLDGLVRNKDF<br>IQLEIDGYNMGISADRFNEDTNYIGTTYGTTHDLTTDFEIIQRQEKYRNYSQLKTP<br>YNIFHKSGLMSTETSKPTFHDYRDWVYSSAWYFQNYENLNLRKHTKTNWYFIPK<br>DEGWDED |
| 74 | WT BoNT/X C467A/C1240A | MKLEINKFNYNDPIDGINVITMRPPRHSDKINKGKGPFKAFQVIKNIWIVPERYNF<br>TNNTNDLNIPSEPIMEADAIYNPNYLNTPSEKDEFLQGVIKVLERIKSKPEGEKLLE<br>LISSSIPLPLVSNGALTLSDNETIAYQENNNIVSNLQANLVIYGPGPDIANNATYGL<br>YSTPISNGEGTLSEVSFSPFYLKPFDESYGNYRSLVNIVNKFVKREFAPDPASTLM<br>HELVHVTHNLYGISNRNFYYNFDTGKIETSRQQNSLIFEELLTFGGIDSKAISSLIIK<br>KIIETAKNNYTTLISERLNTVTVENDLLKYIKNKIPVQGRLGNFKLDTAEFEKKLN<br>TILFVLNESNLAQRFSILVRKHYLKERPIDPIYVNILDDNSYSTLEGFNISSQGSNDF<br>QGQLLESSYFEKIESNALRAFIKICPRNGLLYNAIYRNSKNYLNNIDLEDKKTTSK<br>TNVSYPCSLLNGAIEVENKDLFLISNKDSLNDINLSEEKIKPETTVFFKDKLPPQDI<br>TLSNYDFTEANSIPSISQQNILERNEELYEPIRNSLFEIKTIYVDKLTTFHFLEAQNID<br>ESIDSSKIRVELTDSVDEALSNPNKVYSPFKNMSNTINSIETGITSTYIFYQWLRSIV<br>KDFSDETGKIDVIDKSSDTLAIVPYIGPLLNIGNDIRHGDFVGAIELAGITALLEYVP<br>EFTIPILVGLEVIGGELAREQVEAIVNNALDKRDQKWAEVYNITKAQWWGTIHLQ |

TABLE 1-continued

Exemplary, non-limiting BoNT amino acid sequences

| SEQ ID NO | Description | Sequence |
|---|---|---|
| | | INTRLAHTYKALSRQANAIKMNMEFQLANYKGNIDDKAKIKNAISETEILLNKSV<br>EQAMKNTEKFMIKLSNSYLTKEMIPKVQDNLKNFDLETKKTLDKFIKEKEDILGT<br>NLSSSLRRKVSIRLNKNIAFDINDIPFSEFDDLINQYKNEIEDYEVLNLGAEDGKIK<br>DLSGTTSDINIGSDIELADGRENKAIKIKGSENSTIKIAMNKYLRFSATDNFSISFWI<br>KHPKPTNLLNNGIEYTLVENFNQRGWKISIQDSKLIWYLRDHNNSIKIVTPDYIAF<br>NGWNLITITNNRSKGSIVYVNGSKIEEKDISSIWNTEVDDPIIFRLKNNRDTQAFTL<br>LDQFSIYRKELNQNEVVKLYNYYFNSNYIRDIWGNPLQYNKKYYLQTQDKPGKG<br>LIREYWSSFGYDYVILSDSKTITFPNNIRYGALYNGSKVLIKNSKKLDGLVRNKDF<br>IQLEIDGYNMGISADRFNEDTNYIGTTYGTTHDLTTDFEIIQRQEKYRNYAQLKTP<br>YNIFHKSGLMSTETSKPTFHDYRDWVYSSAWYFQNYENLNLRKHTKTNWYFIPK<br>DEGWDED |
| 75 | WT BoNT/X LC-$H_N$ C461A | MKLEINKFNYNDPIDGINVITMRPPRHSDKINKGKGPFKAFQVIKNIWIVPERYNF<br>TNNTNDLNIPSEPIMEADAIYNPNYLNTPSEKDEFLQGVIKVLERIKSKPEGEKLLE<br>LISSSIPLPLVSNGALTLSDNETIAYQENNNIVSNLQANLVIYGPGPDIANNATYGL<br>YSTPISNGEGTLSEVSFSPFYLKPFDESYGNYRSLVNIVNKFVKREFAPDPASTLM<br>HELVHVTHNLYGISNRNFYYNFDTGKIETSRQQNSLIFEELLTFGGIDSKAISSLIIK<br>KIIETAKNNYTTLISERLNTVTVENDLLKYIKNKIPVQGRLGNFKLDTAEFEKKLN<br>TILFVLNESNLAQRFSILVRKHYLKERPIDPIYVNILDDNSYSTLEGFNISSQGSNDF<br>QGQLLESSYFEKIESNALRAFIKICPRNGLLYNAIYRNSKNYLNNIDLEDKKTTSK<br>TNVSYPASLLNGCIEVENKDLFLISNKDSLNDINLSEEKIKPETTVFFKDKLPPQDI<br>TLSNYDFTEANSIPSISQQNILERNEELYEPIRNSLFEIKTIYVDKLTTFHFLEAQNID<br>ESIDSSKIRVELTDSVDEALSNPNKVYSPFKNMSNTINSIETGITSTYIFYQWLRSIV<br>KDFSDETGKIDVIDKSSDTLAIVPYIGPLLNIGNDIRHGDFVGAIELAGITALLEYVP<br>EFTIPILVGLEVIGGELAREQVEAIVNNALDKRDQKWAEVYNITKAQWWGTIHLQ<br>INTRLAHTYKALSRQANAIKMNMEFQLANYKGNIDDKAKIKNAISETEILLNKSV<br>EQAMKNTEKFMIKLSNSYLTKEMIPKVQDNLKNFDLETKKTLDKFIKEKEDILGT<br>NLSSSLRRKVSIRLNKNIAFDINDIPFSEFDDLINQYKNEI |
| 76 | WT BoNT/X LC-$H_N$ C461S | MKLEINKFNYNDPIDGINVITMRPPRHSDKINKGKGPFKAFQVIKNIWIVPERYNF<br>TNNTNDLNIPSEPIMEADAIYNPNYLNTPSEKDEFLQGVIKVLERIKSKPEGEKLLE<br>LISSSIPLPLVSNGALTLSDNETIAYQENNNIVSNLQANLVIYGPGPDIANNATYGL<br>YSTPISNGEGTLSEVSFSPFYLKPFDESYGNYRSLVNIVNKFVKREFAPDPASTLM<br>HELVHVTHNLYGISNRNFYYNFDTGKIETSRQQNSLIFEELLTFGGIDSKAISSLIIK<br>KIIETAKNNYTTLISERLNTVTVENDLLKYIKNKIPVQGRLGNFKLDTAEFEKKLN<br>TILFVLNESNLAQRFSILVRKHYLKERPIDPIYVNILDDNSYSTLEGFNISSQGSNDF<br>QGQLLESSYFEKIESNALRAFIKICPRNGLLYNAIYRNSKNYLNNIDLEDKKTTSK<br>TNVSYPSSLLNGCIEVENKDLFLISNKDSLNDINLSEEKIKPETTVFFKDKLPPQDIT<br>LSNYDFTEANSIPSISQQNILERNEELYEPIRNSLFEIKTIYVDKLTTFHFLEAQNIDE<br>SIDSSKIRVELTDSVDEALSNPNKVYSPFKNMSNTINSIETGITSTYIFYQWLRSIVK<br>DFSDETGKIDVIDKSSDTLAIVPYIGPLLNIGNDIRHGDFVGAIELAGITALLEYVPE<br>FTIPILVGLEVIGGELAREQVEAIVNNALDKRDQKWAEVYNITKAQWWGTIHLQI<br>NTRLAHTYKALSRQANAIKMNMEFQLANYKGNIDDKAKIKNAISETEILLNKSVE<br>QAMKNTEKFMIKLSNSYLTKEMIPKVQDNLKNFDLETKKTLDKFIKEKEDILGTN<br>LSSSLRRKVSIRLNKNIAFDINDIPFSEFDDLINQYKNEI |
| 77 | WT BoNT/X LC-$H_N$ C467A | MKLEINKFNYNDPIDGINVITMRPPRHSDKINKGKGPFKAFQVIKNIWIVPERYNF<br>TNNTNDLNIPSEPIMEADAIYNPNYLNTPSEKDEFLQGVIKVLERIKSKPEGEKLLE<br>LISSSIPLPLVSNGALTLSDNETIAYQENNNIVSNLQANLVIYGPGPDIANNATYGL<br>YSTPISNGEGTLSEVSFSPFYLKPFDESYGNYRSLVNIVNKFVKREFAPDPASTLM<br>HELVHVTHNLYGISNRNFYYNFDTGKIETSRQQNSLIFEELLTFGGIDSKAISSLIIK<br>KIIETAKNNYTTLISERLNTVTVENDLLKYIKNKIPVQGRLGNFKLDTAEFEKKLN<br>TILFVLNESNLAQRFSILVRKHYLKERPIDPIYVNILDDNSYSTLEGFNISSQGSNDF<br>QGQLLESSYFEKIESNALRAFIKICPRNGLLYNAIYRNSKNYLNNIDLEDKKTTSK<br>TNVSYPCSLLNGAIEVENKDLFLISNKDSLNDINLSEEKIKPETTVFFKDKLPPQDI<br>TLSNYDFTEANSIPSISQQNILERNEELYEPIRNSLFEIKTIYVDKLTTFHFLEAQNID<br>ESIDSSKIRVELTDSVDEALSNPNKVYSPFKNMSNTINSIETGITSTYIFYQWLRSIV<br>KDFSDETGKIDVIDKSSDTLAIVPYIGPLLNIGNDIRHGDFVGAIELAGITALLEYVP<br>EFTIPILVGLEVIGGELAREQVEAIVNNALDKRDQKWAEVYNITKAQWWGTIHLQ<br>INTRLAHTYKALSRQANAIKMNMEFQLANYKGNIDDKAKIKNAISETEILLNKSV<br>EQAMKNTEKFMIKLSNSYLTKEMIPKVQDNLKNFDLETKKTLDKFIKEKEDILGT<br>NLSSSLRRKVSIRLNKNIAFDINDIPFSEFDDLINQYKNEI |
| 78 | WT BoNT/X LC-$H_N$ C467S | MKLEINKFNYNDPIDGINVITMRPPRHSDKINKGKGPFKAFQVIKNIWIVPERYNF<br>TNNTNDLNIPSEPIMEADAIYNPNYLNTPSEKDEFLQGVIKVLERIKSKPEGEKLLE<br>LISSSIPLPLVSNGALTLSDNETIAYQENNNIVSNLQANLVIYGPGPDIANNATYGL<br>YSTPISNGEGTLSEVSFSPFYLKPFDESYGNYRSLVNIVNKFVKREFAPDPASTLM<br>HELVHVTHNLYGISNRNFYYNFDTGKIETSRQQNSLIFEELLTFGGIDSKAISSLIIK<br>KIIETAKNNYTTLISERLNTVTVENDLLKYIKNKIPVQGRLGNFKLDTAEFEKKLN<br>TILFVLNESNLAQRFSILVRKHYLKERPIDPIYVNILDDNSYSTLEGFNISSQGSNDF<br>QGQLLESSYFEKIESNALRAFIKICPRNGLLYNAIYRNSKNYLNNIDLEDKKTTSK<br>TNVSYPCSLLNGSIEVENKDLFLISNKDSLNDINLSEEKIKPETTVFFKDKLPPQDIT<br>LSNYDFTEANSIPSISQQNILERNEELYEPIRNSLFEIKTIYVDKLTTFHFLEAQNIDE<br>SIDSSKIRVELTDSVDEALSNPNKVYSPFKNMSNTINSIETGITSTYIFYQWLRSIVK |

TABLE 1-continued

Exemplary, non-limiting BoNT amino acid sequences

| SEQ ID NO | Description | Sequence |
|---|---|---|
| | | DFSDETGKIDVIDKSSDTLAIVPYIGPLLNIGNDIRHGDFVGAIELAGITALLEYVPE<br>FTIPILVGLEVIGGELAREQVEAIVNNALDKRDQKWAEVYNITKAQWWGTIHLQI<br>NTRLAHTYKALSRQANAIKMNMEFQLANYKGNIDDKAKIKNAISETEILLNKSVE<br>QAMKNTEKFMIKLSNSYLTKEMIPKVQDNLKNFDLETKKTLDKFIKEKEDILGTN<br>LSSSLRRKVSIRLNKNIAFDINDIPFSEFDDLINQYKNEI |
| 79 | BoNT/X-LC-$H_N$-A1-Hc | MKLEINKFNYNDPIDGINVITMRPPRHSDKINKGKGPFKAFQVIKNIWIVPERYNF<br>TNNTNDLNIPSEPIMEADAIYNPNYLNTPSEKDEFLQGVIKVLERIKSKPEGEKLLE<br>LISSSIPLPLVSNGALTLSDNETIAYQENNNIVSNLQANLVIYGPGPDIANNATYGL<br>YSTPISNGEGTLSEVSFSPFYLKPFDESYGNYRSLVNIVNKFVKREFAPDPASTLM<br>HELVHVTHNLYGISNRNFYYNFDTGKIETSRQQNSLIFEELLTFGGIDSKAISSLIIK<br>KIIETAKNNYTTLISERLNTVTVENDLLKYIKNKIPVQGRLGNFKLDTAEFEKKLN<br>TILFVLNESNLAQRFSILVRKHYLKERPIDPIYVNILDDNSYSTLEGFNISSQGSNDF<br>QGQLLESSYFEKIESNALRAFIKICPRNGLLYNAIYRNSKNYLNNIDLEDKKTTSK<br>TNVSYPCSLLNGCIEVENKDLFLISNKDSLNDINLSEEKIKPETTVFFKDKLPPQDIT<br>LSNYDFTEANSIPSISQQNILERNEELYEPIRNSLFEIKTIYVDKLTTFHFLEAQNIDE<br>SIDSSKIRVELTDSVDEALSNPNKVYSPFKNMSNTINSIETGITSTYIFYQWLRSIVK<br>DFSDETGKIDVIDKSSDTLAIVPYIGPLLNIGNDIRHGDFVGAIELAGITALLEYVPE<br>FTIPILVGLEVIGGELAREQVEAIVNNALDKRDQKWAEVYNITKAQWWGTIHLQI<br>NTRLAHTYKALSRQANAIKMNMEFQLANYKGNIDDKAKIKNAISETEILLNKSVE<br>QAMKNTEKFMIKLSNSYLTKEMIPKVQDNLKNFDLETKKTLDKFIKEKEDILGTN<br>LSSSLRRKVSIRLNKNIAFDINDIPFSEFDDLINQYKNEIIINTSILNLRYESNHLIDLS<br>RYASKINIGSKVNFDPIDKNQIQLFNLESSKIEVILKNAIVYNSMYENFSTSFWIRIP<br>KYFNSISLNNEYTIINCMENNSGWKVSLNYGEIIWTLQDTQEIKQRVVFKYSQMI<br>NISDYINRWIFVTITNNRLNNSKIYINGRLIDQKPISNLGNIHASNNIMFKLDGCRD<br>THRYIWIKYFNLFDKELNEKEIKDLYDNQSNSGILKDFWGDYLQYDKPYYMLNL<br>YDPNKYVDVNNVGIRGYMYLKGPRGSVMTTNIYLNSSLYRGTKFIIKKYASGNK<br>DNIVRNNDRVYINVVVKNKEYRLATNASQAGVEKILSALEIPDVGNLSQVVVMK<br>SKNDQGITNKCKMNLQDNNGNDIGFIGFHQFNNIAKLVASNWYNRQIERSSRTL<br>GCSWEFIPVDDGWGERPL |
| 80 | BoNT/X-LC-$H_N$-B1-Hc | MKLEINKFNYNDPIDGINVITMRPPRHSDKINKGKGPFKAFQVIKNIWIVPERYNF<br>TNNTNDLNIPSEPIMEADAIYNPNYLNTPSEKDEFLQGVIKVLERIKSKPEGEKLLE<br>LISSSIPLPLVSNGALTLSDNETIAYQENNNIVSNLQANLVIYGPGPDIANNATYGL<br>YSTPISNGEGTLSEVSFSPFYLKPFDESYGNYRSLVNIVNKFVKREFAPDPASTLM<br>HELVHVTHNLYGISNRNFYYNFDTGKIETSRQQNSLIFEELLTFGGIDSKAISSLIIK<br>KIIETAKNNYTTLISERLNTVTVENDLLKYIKNKIPVQGRLGNFKLDTAEFEKKLN<br>TILFVLNESNLAQRFSILVRKHYLKERPIDPIYVNILDDNSYSTLEGFNISSQGSNDF<br>QGQLLESSYFEKIESNALRAFIKICPRNGLLYNAIYRNSKNYLNNIDLEDKKTTSK<br>TNVSYPCSLLNGCIEVENKDLFLISNKDSLNDINLSEEKIKPETTVFFKDKLPPQDIT<br>LSNYDFTEANSIPSISQQNILERNEELYEPIRNSLFEIKTIYVDKLTTFHFLEAQNIDE<br>SIDSSKIRVELTDSVDEALSNPNKVYSPFKNMSNTINSIETGITSTYIFYQWLRSIVK<br>DFSDETGKIDVIDKSSDTLAIVPYIGPLLNIGNDIRHGDFVGAIELAGITALLEYVPE<br>FTIPILVGLEVIGGELAREQVEAIVNNALDKRDQKWAEVYNITKAQWWGTIHLQI<br>NTRLAHTYKALSRQANAIKMNMEFQLANYKGNIDDKAKIKNAISETEILLNKSVE<br>QAMKNTEKFMIKLSNSYLTKEMIPKVQDNLKNFDLETKKTLDKFIKEKEDILGTN<br>LSSSLRRKVSIRLNKNIAFDINDIPFSEFDDLINQYKNEIILNNIILNLRYKDNNLIDL<br>SGYGAKVEVYDGVELNDKNQFKLTSSANSKIRVTQNQNIIFNSVFLDFSVSFWIRI<br>PKYKNDGIQNYIHNEYTIINCMKNNSGWKISIRGNRIIWTLIDINGKTKSVFPEYNI<br>REDISEYINRWFFVTITNNLNNAKIYINGKLESNTDIKDIREVIANGEIIFKLDGDID<br>RTQFIWMKYFSIFNTELSQSNIEERYKIQSYSEYLKDFWGNPLMYNKEYYMFNAG<br>NKNSYIKLKKDSPVGEILTRSKYNQNSKYINYRDLYIGEKFIIRRKSNSQSINDDIV<br>RKEDYIYLDFFNLNQEWRVYTYKYFKKEEEKLFLAPISDSDEFYNTIQIKEYDEQP<br>TYSCQLLFKKDEESTDEIGLIGIHRFYESGIVFEEYKDYFCISKWYLKEVKRKPYN<br>LKLGCNWQFIPKDEGWTE |
| 81 | BoNT/X-LC-$H_N$-C1-Hc | MKLEINKFNYNDPIDGINVITMRPPRHSDKINKGKGPFKAFQVIKNIWIVPERYNF<br>TNNTNDLNIPSEPIMEADAIYNPNYLNTPSEKDEFLQGVIKVLERIKSKPEGEKLLE<br>LISSSIPLPLVSNGALTLSDNETIAYQENNNIVSNLQANLVIYGPGPDIANNATYGL<br>YSTPISNGEGTLSEVSFSPFYLKPFDESYGNYRSLVNIVNKFVKREFAPDPASTLM<br>HELVHVTHNLYGISNRNFYYNFDTGKIETSRQQNSLIFEELLTFGGIDSKAISSLIIK<br>KIIETAKNNYTTLISERLNTVTVENDLLKYIKNKIPVQGRLGNFKLDTAEFEKKLN<br>TILFVLNESNLAQRFSILVRKHYLKERPIDPIYVNILDDNSYSTLEGFNISSQGSNDF<br>QGQLLESSYFEKIESNALRAFIKICPRNGLLYNAIYRNSKNYLNNIDLEDKKTTSK<br>TNVSYPCSLLNGCIEVENKDLFLISNKDSLNDINLSEEKIKPETTVFFKDKLPPQDIT<br>LSNYDFTEANSIPSISQQNILERNEELYEPIRNSLFEIKTIYVDKLTTFHFLEAQNIDE<br>SIDSSKIRVELTDSVDEALSNPNKVYSPFKNMSNTINSIETGITSTYIFYQWLRSIVK<br>DFSDETGKIDVIDKSSDTLAIVPYIGPLLNIGNDIRHGDFVGAIELAGITALLEYVPE<br>FTIPILVGLEVIGGELAREQVEAIVNNALDKRDQKWAEVYNITKAQWWGTIHLQI<br>NTRLAHTYKALSRQANAIKMNMEFQLANYKGNIDDKAKIKNAISETEILLNKSVE<br>QAMKNTEKFMIKLSNSYLTKEMIPKVQDNLKNFDLETKKTLDKFIKEKEDILGTN<br>LSSSLRRKVSIRLNKNIAFDINDIPFSEFDDLINQYKNEIINDSKILSLQNRKNTLVD<br>TSGYNAEVSEEGDVQLNPIFPFDFKLGSSGEDRGKVIVTQNENIVYNSMYESFSIS<br>FWIRINKWVSNLPGYTIIDSVKNNSGWSIGIISNFLVFTLKQNEDSEQSINFSYDISN |

TABLE 1-continued

Exemplary, non-limiting BoNT amino acid sequences

| SEQ ID NO | Description | Sequence |
|---|---|---|
| | | NAPGYNKWFFVTVTNNMMGNMKIYINGKLIDTIKVKELTGINFSKTITFEINKIPD<br>TGLITSDSDNINMWIRDFYIFAKELDGKDINILFNSLQYTNVVKDYWGNDLRYNK<br>EYYMVNIDYLNRYMYANSRQIVFNTRRNNNDFNEGYKIIIKRIRGNTNDTRVRG<br>GDILYFDMTINNKAYNLFMKNETMYADNHSTEDIYAIGLREQTKDINDNIIFQIQP<br>MNNTYYYASQIFKSNFNGENISGICSIGTYRFRLGGDWYRHNYLVPTVKQGNYA<br>SLLESTSTHWGFVPVSE |
| 82 | BoNT/X-LC-$H_N$-A1-Hc C461S | MKLEINKFNYNDPIDGINVITMRPPRHSDKINKGKGPFKAFQVIKNIWIVPERYNF<br>TNNTNDLNIPSEPIMEADAIYNPNYLNTPSEKDEFLQGVIKVLERIKSKPEGEKLLE<br>LISSSIPLPLVSNGALTLSDNETIAYQENNNIVSNLQANLVIYGPGPDIANNATYGL<br>YSTPISNGEGTLSEVSFSPFYLKPFDESYGNYRSLVNIVNKFVKREFAPDPASTLM<br>HELVHVTHNLYGISNRNFYYNFDTGKIETSRQQNSLIFEELLTFGGIDSKAISSLIIK<br>KIIETAKNNYTTLISERLNTVTVENDLLKYIKNKIPVQGRLGNFKLDTAEFEKKLN<br>TILFVLNESNLAQRFSILVRKHYLKERPIDPIYVNILDDNSYSTLEGFNISSQGSNDF<br>QGQLLESSYFEKIESNALRAFIKICPRNGLLYNAIYRNSKNYLNNIDLEDKKTTSK<br>TNVSYPSSLLNGCIEVENKDLFLISNKDSLNDINLSEEKIKPETTVFFKDKLPPQDIT<br>LSNYDFTEANSIPSISQQNILERNEELYEPIRNSLFEIKTIYVDKLTTFHFLEAQNIDE<br>SIDSSKIRVELTDSVDEALSNPNKVYSPFKNMSNTINSIETGITSTYIFYQWLRSIVK<br>DFSDETGKIDVIDKSSDTLAIVPYIGPLLNIGNDIRHGDFVGAIELAGITALLEYVPE<br>FTIPILVGLEVIGGELAREQVEAIVNNALDKRDQKWAEVYNITKAQWWGTIHLQI<br>NTRLAHTYKALSRQANAIKMNMEFQLANYKGNIDDKAKIKNAISETEILLNKSVE<br>QAMKNTEKFMIKLSNSYLTKEMIPKVQDNLKNFDLETKKTLDKFIKEKEDILGTN<br>LSSSLRRKVSIRLNKNIAFDINDIPFSEFDDLINQYKNEIIINTSILNLRYESNHLIDLS<br>RYASKINIGSKVNFDPIDKNQIQLFNLESSKIEVILKNAIVYNSMYENFSTSFWIRIP<br>KYFNSISLNNEYTIINCMENNSGWKVSLNYGEIIWTLQDTQEIKQRVVFKYSQMI<br>NISDYINRWIFVTITNNRLNNSKIYINGRLIDQKPISNLGNIHASNNIMFKLDGCRD<br>THRYIWIKYFNLFDKELNEKEIKDLYDNQSNSGILKDFWGDYLQYDKPYYMLNL<br>YDPNKYVDVNNVGIRGYMYLKGPRGSVMTTNIYLNSSLYRGTKFIIKKYASGNK<br>DNIVRNNDRVYINVVVKNKEYRLATNASQAGVEKILSALEIPDVGNLSQVVVMK<br>SKNDQGITNKCKMNLQDNNGNDIGFIGFHQFNNIAKLVASNWYNRQIERSSRTL<br>GCSWEFIPVDDGWGERPL |
| 83 | BoNT/X-LC-$H_N$-B1-Hc C461S | MKLEINKFNYNDPIDGINVITMRPPRHSDKINKGKGPFKAFQVIKNIWIVPERYNF<br>TNNTNDLNIPSEPIMEADAIYNPNYLNTPSEKDEFLQGVIKVLERIKSKPEGEKLLE<br>LISSSIPLPLVSNGALTLSDNETIAYQENNNIVSNLQANLVIYGPGPDIANNATYGL<br>YSTPISNGEGTLSEVSFSPFYLKPFDESYGNYRSLVNIVNKFVKREFAPDPASTLM<br>HELVHVTHNLYGISNRNFYYNFDTGKIETSRQQNSLIFEELLTFGGIDSKAISSLIIK<br>KIIETAKNNYTTLISERLNTVTVENDLLKYIKNKIPVQGRLGNFKLDTAEFEKKLN<br>TILFVLNESNLAQRFSILVRKHYLKERPIDPIYVNILDDNSYSTLEGFNISSQGSNDF<br>QGQLLESSYFEKIESNALRAFIKICPRNGLLYNAIYRNSKNYLNNIDLEDKKTTSK<br>TNVSYPSSLLNGCIEVENKDLFLISNKDSLNDINLSEEKIKPETTVFFKDKLPPQDIT<br>LSNYDFTEANSIPSISQQNILERNEELYEPIRNSLFEIKTIYVDKLTTFHFLEAQNIDE<br>SIDSSKIRVELTDSVDEALSNPNKVYSPFKNMSNTINSIETGITSTYIFYQWLRSIVK<br>DFSDETGKIDVIDKSSDTLAIVPYIGPLLNIGNDIRHGDFVGAIELAGITALLEYVPE<br>FTIPILVGLEVIGGELAREQVEAIVNNALDKRDQKWAEVYNITKAQWWGTIHLQI<br>NTRLAHTYKALSRQANAIKMNMEFQLANYKGNIDDKAKIKNAISETEILLNKSVE<br>QAMKNTEKFMIKLSNSYLTKEMIPKVQDNLKNFDLETKKTLDKFIKEKEDILGTN<br>LSSSLRRKVSIRLNKNIAFDINDIPFSEFDDLINQYKNEIILNNIILNLRYKDNNLIDL<br>SGYGAKVEVYDGVELNDKNQFKLTSSANSKIRVTQNQNIIFNSVFLDFSVSFWIRI<br>PKYKNDGIQNYIHNEYTIINCMKNNSGWKISIRGNRIIWTLIDINGKTKSVIMEYNI<br>REDISEYINRWFFVTITNNLNNAKIYINGKLESNTDIKDIREVIANGEIIFKLDGDID<br>RTQFIWMKYFSIFNTELSQSNIEERYKIQSYSEYLKDFWGNPLMYNKEYYMFNAG<br>NKNSYIKLKKDSPVGEILTRSKYNQNSKYINYRDLYIGEKFIIRRKSNSQSINDDIV<br>RKEDYIYLDFFNLNQEWRVYTYKYFKKEEEKLFLAPISDSDEFYNTIQIKEYDEQP<br>TYSCQLLFKKDEESTDEIGLIGIHRFYESGIVFEEYKDYFCISKWYLKEVKRKPYN<br>LKLGCNWQFIPKDEGWTE |
| 84 | BoNT/X-LC-$H_N$-C1-Hc C461s | MKLEINKFNYNDPIDGINVITMRPPRHSDKINKGKGPFKAFQVIKNIWIVPERYNFT<br>NNTNDLNIPSEPIMEADAIYNPNYLNTPSEKDEFLQGVIKVLERIKSKPEGEKLLEL<br>ISSSIPLPLVSNGALTLSDNETIAYQENNNIVSNLQANLVIYGPGPDIANNATYGLY<br>STPISNGEGTLSEVSFSPFYLKPFDESYGNYRSLVNIVNKFVKREFAPDPASTLMHE<br>LVHVTHNLYGISNRNFYYNFDTGKIETSRQQNSLIFEELLTFGGIDSKAISSLIIKKII<br>ETAKNNYTTLISERLNTVTVENDLLKYIKNKIPVQGRLGNFKLDTAEFEKKLNTIL<br>FVLNESNLAQRFSILVRKHYLKERPIDPIYVNILDDNSYSTLEGFNISSQGSNDFQG<br>QLLESSYFEKIESNALRAFIKICPRNGLLYNAIYRNSKNYLNNIDLEDKKTTSKTNV<br>SYPSSLLNGCIEVENKDLFLISNKDSLNDINLSEEKIKPETTVFFKDKLPPQDITLSN<br>YDFTEANSIPSISQQNILERNEELYEPIRNSLFEIKTIYVDKLTTFHFLEAQNIDESIDS<br>SKIRVELTDSVDEALSNPNKVYSPFKNMSNTINSIETGITSTYIFYQWLRSIVKDFS<br>DETGKIDVIDKSSDTLAIVPYIGPLLNIGNDIRHGDFVGAIELAGITALLEYVPEFTIP<br>ILVGLEVIGGELAREQVEAIVNNALDKRDQKWAEVYNITKAQWWGTIHLQINTR<br>LAHTYKALSRQANAIKMNMEFQLANYKGNIDDKAKIKNAISETEILLNKSVEQA<br>MKNTEKFMIKLSNSYLTKEMIPKVQDNLKNFDLETKKTLDKFIKEKEDILGTNLSS<br>SLRRKVSIRLNKNIAFDINDIPFSEFDDLINQYKNEIINDSKILSLQNRKNTLVDTSG<br>YNAEVSEEGDVQLNPIFPFDFKLGSSGEDRGKVIVTQNENIVYNSMYESFSISFWIR |

TABLE 1-continued

Exemplary, non-limiting BoNT amino acid sequences

| SEQ ID NO | Description | Sequence |
| --- | --- | --- |
| | | INKWVSNLPGYTIIDSVKNNSGWSIGIISNFLVFTLKQNEDSEQSINFSYDISNNAPG<br>YNKWFFVTVTNNMMGNMKIYINGKLIDTIKVKELTGINFSKTITFEINKIPDTGLIT<br>SDSDNINMWIRDFYIFAKELDGKDINILFNSLQYTNVVKDYWGNDLRYNKEYYM<br>VNIDYLNRYMYANSRQIVFNTRRNNNDFNEGYKIIIKRIRGNTNDTRVRGGDILYF<br>DMTINNKAYNLFMKNETMYADNHSTEDIYAIGLREQTKDINDNIIFQIQPMNNTY<br>YYASQIFKSNFNGENISGICSIGTYRFRLGGDWYRHNYLVPTVKQGNYASLLESTS<br>THWGFVPVSE |
| 85 | BoNT/X-LC-$H_N$-A1-Hc C467S | MKLEINKFNYNDPIDGINVITMRPPRHSDKINKGKGPFKAFQVIKNIWIVPERYNFT<br>NNTNDLNIPSEPIMEADAIYNPNYLNTPSEKDEFLQGVIKVLERIKSKPEGEKLLEL<br>ISSSIPLPLVSNGALTLSDNETIAYQENNNIVSNLQANLVIYGPGPDIANNATYGLY<br>STPISNGEGTLSEVSFSPFYLKPFDESYGNYRSLVNIVNKFVKREFAPDPASTLMHE<br>LVHVTHNLYGISNRNFYYNFDTGKIETSRQQNSLIFEELLTFGGIDSKAISSLIIKKII<br>ETAKNNYTTLISERLNTVTVENDLLKYIKNKIPVQGRLGNFKLDTAEFEKKLNTIL<br>FVLNESNLAQRFSILVRKHYLKERPIDPIYVNILDDNSYSTLEGFNISSQGSNDFQG<br>QLLESSYFEKIESNALRAFIKICPRNGLLYNAIYRNSKNYLNNIDLEDKKTTSKTNV<br>SYPCSLLNGSIEVENKDLFLISNKDSLNDINLSEEKIKPETTVFFKDKLPPQDITLSN<br>YDFTEANSIPSISQQNILERNEELYEPIRNSLFEIKTIYVDKLTTFHFLEAQNIDESIDS<br>SKIRVELTDSVDEALSNPNKVYSPFKNMSNTINSIETGITSTYIFYQWLRSIVKDFS<br>DETGKIDVIDKSSDTLAIVPYIGPLLNIGNDIRHGDFVGAIELAGITALLEYVPEFTIP<br>ILVGLEVIGGELAREQVEAIVNNALDKRDQKWAEVYNITKAQWWGTIHLQINTR<br>LAHTYKALSRQANAIKMNMEFQLANYKGNIDDKAKIKNAISETEILLNKSVEQA<br>MKNTEKFMIKLSNSYLTKEMIPKVQDNLKNFDLETKKTLDKFIKEKEDILGTNLSS<br>SLRRKVSIRLNKNIAFDINDIPFSEFDDLINQYKNEIINTSILNLRYESNHLIDLSRY<br>ASKINIGSKVNFDPIDKNQIQLFNLESSKIEVILKNAIVYNSMYENFSTSFWIRIPKY<br>FNSISLNNEYTIINCMENNSGWKVSLNYGEIIWTLQDTQEIKQRVVFKYSQMINIS<br>DYINRWIFVTITNNRLNNSKIYINGRLIDQKPISNLGNIHASNNIMFKLDGCRDTHR<br>YIWIKYFNLFDKELNEKEIKDLYDNQSNSGILKDFWGDYLQYDKPYYMLNLYDP<br>NKYVDVNNVGIRGYMYLKGPRGSVMTTNIYLNSSLYRGTKFIIKKYASGNKDNI<br>VRNNDRVYINVVVKNKEYRLATNASQAGVEKILSALEIPDVGNLSQVVVMKSKN<br>DQGITNKCKMNLQDNNGNDIGFIGFHQFNNIAKLVASNWYNRQIERSSRTLGCS<br>WEFIPVDDGWGERPL |
| 86 | BoNT/X-LC-$H_N$-B1-Hc C467S | MKLEINKFNYNDPIDGINVITMRPPRHSDKINKGKGPFKAFQVIKNIWIVPERYNFT<br>NNTNDLNIPSEPIMEADAIYNPNYLNTPSEKDEFLQGVIKVLERIKSKPEGEKLLEL<br>ISSSIPLPLVSNGALTLSDNETIAYQENNNIVSNLQANLVIYGPGPDIANNATYGLY<br>STPISNGEGTLSEVSFSPFYLKPFDESYGNYRSLVNIVNKFVKREFAPDPASTLMHE<br>LVHVTHNLYGISNRNFYYNFDTGKIETSRQQNSLIFEELLTFGGIDSKAISSLIIKKII<br>ETAKNNYTTLISERLNTVTVENDLLKYIKNKIPVQGRLGNFKLDTAEFEKKLNTIL<br>FVLNESNLAQRFSILVRKHYLKERPIDPIYVNILDDNSYSTLEGFNISSQGSNDFQG<br>QLLESSYFEKIESNALRAFIKICPRNGLLYNAIYRNSKNYLNNIDLEDKKTTSKTNV<br>SYPCSLLNGSIEVENKDLFLISNKDSLNDINLSEEKIKPETTVFFKDKLPPQDITLSN<br>YDFTEANSIPSISQQNILERNEELYEPIRNSLFEIKTIYVDKLTTFHFLEAQNIDESIDS<br>SKIRVELTDSVDEALSNPNKVYSPFKNMSNTINSIETGITSTYIFYQWLRSIVKDFS<br>DETGKIDVIDKSSDTLAIVPYIGPLLNIGNDIRHGDFVGAIELAGITALLEYVPEFTIP<br>ILVGLEVIGGELAREQVEAIVNNALDKRDQKWAEVYNITKAQWWGTIHLQINTR<br>LAHTYKALSRQANAIKMNMEFQLANYKGNIDDKAKIKNAISETEILLNKSVEQA<br>MKNTEKFMIKLSNSYLTKEMIPKVQDNLKNFDLETKKTLDKFIKEKEDILGTNLSS<br>SLRRKVSIRLNKNIAFDINDIPFSEFDDLINQYKNEIILNNIILNLRYKDNNLIDLSGY<br>GAKVEVYDGVELNDKNQFKLTSSANSKIRVTQNQNIIFNSVFLDFSVSFWIRIPKY<br>KNDGIQNYIHNEYTIINCMKNNSGWKISIRGNRIIWTLIDINGKTKSVFFEYNIREDI<br>SEYINRWFFVTITNNLNNAKIYINGKLESNTDIKDIREVIANGEIIFKLDGDIDRTQFI<br>WMKYFSIFNTELSQSNIEERYKIQSYSEYLKDFWGNPLMYNKEYYMFNAGNKNS<br>YIKLKKDSPVGEILTRSKYNQNSKYINYRDLYIGEKFIIRRKSNSQSINDDIVRKED<br>YIYLDFFNLNQEWRVYTYKYFKKEEEKLFLAPISDSDEFYNTIQIKEYDEQPTYSC<br>QLLFKKDEESTDEIGLIGIHRFYESGIVFEEYKDYFCISKWYLKEVKRKPYNLKLG<br>CNWQFIPKDEGWTE |
| 87 | BoNT/X-LC-$H_N$-C1-Hc C467S | MKLEINKFNYNDPIDGINVITMRPPRHSDKINKGKGPFKAFQVIKNIWIVPERYNFT<br>NNTNDLNIPSEPIMEADAIYNPNYLNTPSEKDEFLQGVIKVLERIKSKPEGEKLLEL<br>ISSSIPLPLVSNGALTLSDNETIAYQENNNIVSNLQANLVIYGPGPDIANNATYGLY<br>STPISNGEGTLSEVSFSPFYLKPFDESYGNYRSLVNIVNKFVKREFAPDPASTLMHE<br>LVHVTHNLYGISNRNFYYNFDTGKIETSRQQNSLIFEELLTFGGIDSKAISSLIIKKII<br>ETAKNNYTTLISERLNTVTVENDLLKYIKNKIPVQGRLGNFKLDTAEFEKKLNTIL<br>FVLNESNLAQRFSILVRKHYLKERPIDPIYVNILDDNSYSTLEGFNISSQGSNDFQG<br>QLLESSYFEKIESNALRAFIKICPRNGLLYNAIYRNSKNYLNNIDLEDKKTTSKTNV<br>SYPCSLLNGSIEVENKDLFLISNKDSLNDINLSEEKIKPETTVFFKDKLPPQDITLSN<br>YDFTEANSIPSISQQNILERNEELYEPIRNSLFEIKTIYVDKLTTFHFLEAQNIDESIDS<br>SKIRVELTDSVDEALSNPNKVYSPFKNMSNTINSIETGITSTYIFYQWLRSIVKDFS<br>DETGKIDVIDKSSDTLAIVPYIGPLLNIGNDIRHGDFVGAIELAGITALLEYVPEFTIP<br>ILVGLEVIGGELAREQVEAIVNNALDKRDQKWAEVYNITKAQWWGTIHLQINTR<br>LAHTYKALSRQANAIKMNMEFQLANYKGNIDDKAKIKNAISETEILLNKSVEQA<br>MKNTEKFMIKLSNSYLTKEMIPKVQDNLKNFDLETKKTLDKFIKEKEDILGTNLSS<br>SLRRKVSIRLNKNIAFDINDIPFSEFDDLINQYKNEIINDSKILSLQNRKNTLVDTSG |

TABLE 1-continued

Exemplary, non-limiting BoNT amino acid sequences

| SEQ ID NO | Description | Sequence |
|---|---|---|
| | | YNAEVSEEGDVQLNPIFPFDFKLGSSGEDRGKVIVTQNENIVYNSMYESFSISFWIR<br>INKWVSNLPGYTIIDSVKNNSGWSIGIISNFLVFTLKQNEDSEQSINFSYDISNNAPG<br>YNKWFFVTVTNNMMGNMKIYINGKLIDTIKVKELTGINFSKTITFEINKIPDTGLIT<br>SDSDNINMWIRDFYIFAKELDGKDINILFNSLQYTNVVKDYWGNDLRYNKEYYM<br>VNIDYLNRYMYANSRQIVFNTRRNNNDFNEGYKIIIKRIRGNTNDTRVRGGDILYF<br>DMTINNKAYNLFMKNETMYADNHSTEDIYAIGLREQTKDINDNIIFQIQPMNNTY<br>YYASQIFKSNFNGENISGICSIGTYRFRLGGDWYRHNYLVPTVKQGNYASLLESTS<br>THWGFVPVSE |
| 88 | BoNT/X R360A/Y363F | MKLEINKFNYNDPIDGINVITMRPPRHSDKINKGKGPFKAFQVIKNIWIVPERYNFT<br>NNTNDLNIPSEPIMEADAIYNPNYLNTPSEKDEFLQGVIKVLERIKSKPEGEKLLEL<br>ISSSIPLPLVSNGALTLSDNETIAYQENNNIVSNLQANLVIYGPGPDIANNATYGLY<br>STPISNGEGTLSEVSFSPFYLKPFDESYGNYRSLVNIVNKFVKREFAPDPASTLMHE<br>LVHVTHNLYGISNRNFYYNFDTGKIETSRQQNSLIFEELLTFGGIDSKAISSLIIKKII<br>ETAKNNYTTLISERLNTVTVENDLLKYIKNKIPVQGRLGNFKLDTAEFEKKLNTIL<br>FVLNESNLAQRFSILVAKHFLKERPIDPIYVNILDDNSYSTLEGFNISSQGSNDFQG<br>QLLESSYFEKIESNALRAFIKICPRNGLLYNAIYRNSKNYLNNIDLEDKKTTSKTNV<br>SYPCSLLNGCIEVENKDLFLISNKDSLNDINLSEEKIKPETTVFFKDKLPPQDITLSN<br>YDFTEANSIPSISQQNILERNEELYEPIRNSLFEIKTIYVDKLTTFHFLEAQNIDESIDS<br>SKIRVELTDSVDEALSNPNKVYSPFKNMSNTINSIETGITSTYIFYQWLRSIVKDFS<br>DETGKIDVIDKSSDTLAIVPYIGPLLNIGNDIRHGDFVGAIELAGITALLEYVPEFTIP<br>ILVGLEVIGGELAREQVEAIVNNALDKRDQKWAEVYNITKAQWWGTIHLQINTR<br>LAHTYKALSRQANAIKMNMEFQLANYKGNIDDKAKIKNAISETEILLNKSVEQA<br>MKNTEKFMIKLSNSYLTKEMIPKVQDNLKNFDLETKKTLDKFIKEKEDILGTNLSS<br>SLRRKVSIRLNKNIAFDINDIPFSEFDDLINQYKNEIEDYEVLNLGAEDGKIKDLSG<br>TTSDINIGSDIELADGRENKAIKIKGSENSTIKIAMNKYLRFSATDNFSISFWIKHPK<br>PTNLLNNGIEYTLVENFNQRGWKISIQDSKLIWYLRDHNNSIKIVTPDYIAFNGWN<br>LITITNNRSKGSIVYVNGSKIEEKDISSIWNTEVDDPIIFRLKNNRDTQAFTLLDQFSI<br>YRKELNQNEVVKLYNYYFNSNYIRDIWGNPLQYNKKYYLQTQDKPGKGLIREY<br>WSSFGYDYVILSDSKTITFPNNIRYGALYNGSKVLIKNSKKLDGLVRNKDFIQLEI<br>DGYNMGISADRFNEDTNYIGTTYGTTHDLTTDFEIIQRQEKYRNYCQLKTPYNIFH<br>KSGLMSTETSKPTFHDYRDWVYSSAWYFQNYENLNLRKHTKTNWYFIPKDEGW<br>DED |
| 89 | BoNT/X H227Y | MKLEINKFNYNDPIDGINVITMRPPRHSDKINKGKGPFKAFQVIKNIWIVPERYNFT<br>NNTNDLNIPSEPIMEADAIYNPNYLNTPSEKDEFLQGVIKVLERIKSKPEGEKLLEL<br>ISSSIPLPLVSNGALTLSDNETIAYQENNNIVSNLQANLVIYGPGPDIANNATYGLY<br>STPISNGEGTLSEVSFSPFYLKPFDESYGNYRSLVNIVNKFVKREFAPDPASTLMYE<br>LVHVTHNLYGISNRNFYYNFDTGKIETSRQQNSLIFEELLTFGGIDSKAISSLIIKKII<br>ETAKNNYTTLISERLNTVTVENDLLKYIKNKIPVQGRLGNFKLDTAEFEKKLNTIL<br>FVLNESNLAQRFSILVRKHYLKERPIDPIYVNILDDNSYSTLEGFNISSQGSNDFQG<br>QLLESSYFEKIESNALRAFIKICPRNGLLYNAIYRNSKNYLNNIDLEDKKTTSKTNV<br>SYPCSLLNGCIEVENKDLFLISNKDSLNDINLSEEKIKPETTVFFKDKLPPQDITLSN<br>YDFTEANSIPSISQQNILERNEELYEPIRNSLFEIKTIYVDKLTTFHFLEAQNIDESIDS<br>SKIRVELTDSVDEALSNPNKVYSPFKNMSNTINSIETGITSTYIFYQWLRSIVKDFS<br>DETGKIDVIDKSSDTLAIVPYIGPLLNIGNDIRHGDFVGAIELAGITALLEYVPEFTIP<br>ILVGLEVIGGELAREQVEAIVNNALDKRDQKWAEVYNITKAQWWGTIHLQINTR<br>LAHTYKALSRQANAIKMNMEFQLANYKGNIDDKAKIKNAISETEILLNKSVEQA<br>MKNTEKFMIKLSNSYLTKEMIPKVQDNLKNFDLETKKTLDKFIKEKEDILGTNLSS<br>SLRRKVSIRLNKNIAFDINDIPFSEFDDLINQYKNEIEDYEVLNLGAEDGKIKDLSG<br>TTSDINIGSDIELADGRENKAIKIKGSENSTIKIAMNKYLRFSATDNFSISFWIKHPK<br>PTNLLNNGIEYTLVENFNQRGWKISIQDSKLIWYLRDHNNSIKIVTPDYIAFNGWN<br>LITITNNRSKGSIVYVNGSKIEEKDISSIWNTEVDDPIIFRLKNNRDTQAFTLLDQFSI<br>YRKELNQNEVVKLYNYYFNSNYIRDIWGNPLQYNKKYYLQTQDKPGKGLIREY<br>WSSFGYDYVILSDSKTITFPNNIRYGALYNGSKVLIKNSKKLDGLVRNKDFIQLEI<br>DGYNMGISADRFNEDTNYIGTTYGTTHDLTTDFEIIQRQEKYRNYCQLKTPYNIFH<br>KSGLMSTETSKPTFHDYRDWVYSSAWYFQNYENLNLRKHTKTNWYFIPKDEGW<br>DED |
| 90 | BoNT/X E228Q | MKLEINKFNYNDPIDGINVITMRPPRHSDKINKGKGPFKAFQVIKNIWIVPERYNFT<br>NNTNDLNIPSEPIMEADAIYNPNYLNTPSEKDEFLQGVIKVLERIKSKPEGEKLLEL<br>ISSSIPLPLVSNGALTLSDNETIAYQENNNIVSNLQANLVIYGPGPDIANNATYGLY<br>STPISNGEGTLSEVSFSPFYLKPFDESYGNYRSLVNIVNKFVKREFAPDPASTLMHQ<br>LVHVTHNLYGISNRNFYYNFDTGKIETSRQQNSLIFEELLTFGGIDSKAISSLIIKKII<br>ETAKNNYTTLISERLNTVTVENDLLKYIKNKIPVQGRLGNFKLDTAEFEKKLNTIL<br>FVLNESNLAQRFSILVRKHYLKERPIDPIYVNILDDNSYSTLEGFNISSQGSNDFQG<br>QLLESSYFEKIESNALRAFIKICPRNGLLYNAIYRNSKNYLNNIDLEDKKTTSKTNV<br>SYPCSLLNGCIEVENKDLFLISNKDSLNDINLSEEKIKPETTVFFKDKLPPQDITLSN<br>YDFTEANSIPSISQQNILERNEELYEPIRNSLFEIKTIYVDKLTTFHFLEAQNIDESIDS<br>SKIRVELTDSVDEALSNPNKVYSPFKNMSNTINSIETGITSTYIFYQWLRSIVKDFS<br>DETGKIDVIDKSSDTLAIVPYIGPLLNIGNDIRHGDFVGAIELAGITALLEYVPEFTIP<br>ILVGLEVIGGELAREQVEAIVNNALDKRDQKWAEVYNITKAQWWGTIHLQINTR<br>LAHTYKALSRQANAIKMNMEFQLANYKGNIDDKAKIKNAISETEILLNKSVEQA<br>MKNTEKFMIKLSNSYLTKEMIPKVQDNLKNFDLETKKTLDKFIKEKEDILGTNLSS |

TABLE 1-continued

Exemplary, non-limiting BoNT amino acid sequences

| SEQ ID NO | Description | Sequence |
|---|---|---|
| | | SLRRKVSIRLNKNIAFDINDIPFSEFDDLINQYKNEIEDYEVLNLGAEDGKIKDLSG<br>TTSDINIGSDIELADGRENKAIKIKGSENSTIKIAMNKYLRFSATDNFSISFWIKHPK<br>PTNLLNNGIEYTLVENFNQRGWKISIQDSKLIWYLRDHNNSIKIVTPDYIAFNGWN<br>LITITNNRSKGSIVYVNGSKIEEKDISSIWNTEVDDPIIFRLKNNRDTQAFTLLDQFSI<br>YRKELNQNEVVKLYNYYFNSNYIRDIWGNPLQYNKKYYLQTQDKPGKGLIREY<br>WSSFGYDYVILSDSKTITFPNNIRYGALYNGSKVLIKNSKKLDGLVRNKDFIQLEI<br>DGYNMGISADRFNEDTNYIGTTYGTTHDLTTDFEIIQRQEKYRNYCQLKTPYNIFH<br>KSGLMSTETSKPTFHDYRDWVYSSAWYFQNYENLNLRKHTKTNWYFIPKDEGW<br>DED |
| 91 | BoNT/X H231Y | MKLEINKFNYNDPIDGINVITMRPPRHSDKINKGKGPFKAFQVIKNIWIVPERYNFT<br>NNTNDLNIPSEPIMEADAIYNPNYLNTPSEKDEFLQGVIKVLERIKSKPEGEKLLEL<br>ISSSIPLPLVSNGALTLSDNETIAYQENNNIVSNLQANLVIYGPGPDIANNATYGLY<br>STPISNGEGTLSEVSFSPFYLKPFDESYGNYRSLVNIVNKFVKREFAPDPASTLMHE<br>LVYVTHNLYGISNRNFYYNFDTGKIETSRQQNSLIFEELLTFGGIDSKAISSLIIKKII<br>ETAKNNYTTLISERLNTVTVENDLLKYIKNKIPVQGRLGNFKLDTAEFEKKLNTIL<br>FVLNESNLAQRFSILVRKHYLKERPIDPIYVNILDDNSYSTLEGFNISSQGSNDFQG<br>QLLESSYFEKIESNALRAFIKICPRNGLLYNAIYRNSKNYLNNIDLEDKKTTSKTNV<br>SYPCSLLNGCIEVENKDLFLISNKDSLNDINLSEEKIKPETTVFFKDKLPPQDITLSN<br>YDFTEANSIPSISQQNILERNEELYEPIRNSLFEIKTIYVDKLTTFHFLEAQNIDESIDS<br>SKIRVELTDSVDEALSNPNKVYSPFKNMSNTINSIETGITSTYIFYQWLRSIVKDFS<br>DETGKIDVIDKSSDTLAIVPYIGPLLNIGNDIRHGDFVGAIELAGITALLEYVPEFTIP<br>ILVGLEVIGGELAREQVEAIVNNALDKRDQKWAEVYNITKAQWWGTIHLQINTR<br>LAHTYKALSRQANAIKMNMEFQLANYKGNIDDKAKIKNAISETEILLNKSVEQA<br>MKNTEKFMIKLSNSYLTKEMIPKVQDNLKNFDLETKKTLDKFIKEKEDILGTNLSS<br>SLRRKVSIRLNKNIAFDINDIPFSEFDDLINQYKNEIEDYEVLNLGAEDGKIKDLSG<br>TTSDINIGSDIELADGRENKAIKIKGSENSTIKIAMNKYLRFSATDNFSISFWIKHPK<br>PTNLLNNGIEYTLVENFNQRGWKISIQDSKLIWYLRDHNNSIKIVTPDYIAFNGWN<br>LITITNNRSKGSIVYVNGSKIEEKDISSIWNTEVDDPIIFRLKNNRDTQAFTLLDQFSI<br>YRKELNQNEVVKLYNYYFNSNYIRDIWGNPLQYNKKYYLQTQDKPGKGLIREY<br>WSSFGYDYVILSDSKTITFPNNIRYGALYNGSKVLIKNSKKLDGLVRNKDFIQLEI<br>DGYNMGISADRFNEDTNYIGTTYGTTHDLTTDFEIIQRQEKYRNYCQLKTPYNIFH<br>KSGLMSTETSKPTFHDYRDWVYSSAWYFQNYENLNLRKHTKTNWYFIPKDEGW<br>DED |
| 92 | BoNT/X-LC-$H_N$ R360A/Y363F | MKLEINKFNYNDPIDGINVITMRPPRHSDKINKGKGPFKAFQVIKNIWIVPERYNFT<br>NNTNDLNIPSEPIMEADAIYNPNYLNTPSEKDEFLQGVIKVLERIKSKPEGEKLLEL<br>ISSSIPLPLVSNGALTLSDNETIAYQENNNIVSNLQANLVIYGPGPDIANNATYGLY<br>STPISNGEGTLSEVSFSPFYLKPFDESYGNYRSLVNIVNKFVKREFAPDPASTLMHE<br>LVHVTHNLYGISNRNFYYNFDTGKIETSRQQNSLIFEELLTFGGIDSKAISSLIIKKII<br>ETAKNNYTTLISERLNTVTVENDLLKYIKNKIPVQGRLGNFKLDTAEFEKKLNTIL<br>FVLNESNLAQRFSILVAKHFLKERPIDPIYVNILDDNSYSTLEGFNISSQGSNDFQG<br>QLLESSYFEKIESNALRAFIKICPRNGLLYNAIYRNSKNYLNNIDLEDKKTTSKTNV<br>SYPCSLLNGCIEVENKDLFLISNKDSLNDINLSEEKIKPETTVFFKDKLPPQDITLSN<br>YDFTEANSIPSISQQNILERNEELYEPIRNSLFEIKTIYVDKLTTFHFLEAQNIDESIDS<br>SKIRVELTDSVDEALSNPNKVYSPFKNMSNTINSIETGITSTYIFYQWLRSIVKDFS<br>DETGKIDVIDKSSDTLAIVPYIGPLLNIGNDIRHGDFVGAIELAGITALLEYVPEFTIP<br>ILVGLEVIGGELAREQVEAIVNNALDKRDQKWAEVYNITKAQWWGTIHLQINTR<br>LAHTYKALSRQANAIKMNMEFQLANYKGNIDDKAKIKNAISETEILLNKSVEQA<br>MKNTEKFMIKLSNSYLTKEMIPKVQDNLKNFDLETKKTLDKFIKEKEDILGTNLSS<br>SLRRKVSIRLNKNIAFDINDIPFSEFDDLINQYKNEI |
| 93 | BoNT/X-LC-$H_N$ H227Y | MKLEINKFNYNDPIDGINVITMRPPRHSDKINKGKGPFKAFQVIKNIWIVPERYNFT<br>NNTNDLNIPSEPIMEADAIYNPNYLNTPSEKDEFLQGVIKVLERIKSKPEGEKLLEL<br>ISSSIPLPLVSNGALTLSDNETIAYQENNNIVSNLQANLVIYGPGPDIANNATYGLY<br>STPISNGEGTLSEVSFSPFYLKPFDESYGNYRSLVNIVNKFVKREFAPDPASTLMYE<br>LVHVTHNLYGISNRNFYYNFDTGKIETSRQQNSLIFEELLTFGGIDSKAISSLIIKKII<br>ETAKNNYTTLISERLNTVTVENDLLKYIKNKIPVQGRLGNFKLDTAEFEKKLNTIL<br>FVLNESNLAQRFSILVRKHYLKERPIDPIYVNILDDNSYSTLEGFNISSQGSNDFQG<br>QLLESSYFEKIESNALRAFIKICPRNGLLYNAIYRNSKNYLNNIDLEDKKTTSKTNV<br>SYPCSLLNGCIEVENKDLFLISNKDSLNDINLSEEKIKPETTVFFKDKLPPQDITLSN<br>YDFTEANSIPSISQQNILERNEELYEPIRNSLFEIKTIYVDKLTTFHFLEAQNIDESIDS<br>SKIRVELTDSVDEALSNPNKVYSPFKNMSNTINSIETGITSTYIFYQWLRSIVKDFS<br>DETGKIDVIDKSSDTLAIVPYIGPLLNIGNDIRHGDFVGAIELAGITALLEYVPEFTIP<br>ILVGLEVIGGELAREQVEAIVNNALDKRDQKWAEVYNITKAQWWGTIHLQINTR<br>LAHTYKALSRQANAIKMNMEFQLANYKGNIDDKAKIKNAISETEILLNKSVEQA<br>MKNTEKFMIKLSNSYLTKEMIPKVQDNLKNFDLETKKTLDKFIKEKEDILGTNLSS<br>SLRRKVSIRLNKNIAFDINDIPFSEFDDLINQYKNEI |
| 94 | BoNT/X-LC-$H_N$ E228Q | MKLEINKFNYNDPIDGINVITMRPPRHSDKINKGKGPFKAFQVIKNIWIVPERYNFT<br>NNTNDLNIPSEPIMEADAIYNPNYLNTPSEKDEFLQGVIKVLERIKSKPEGEKLLEL<br>ISSSIPLPLVSNGALTLSDNETIAYQENNNIVSNLQANLVIYGPGPDIANNATYGLY<br>STPISNGEGTLSEVSFSPFYLKPFDESYGNYRSLVNIVNKFVKREFAPDPASTLMHQ<br>LVHVTHNLYGISNRNFYYNFDTGKIETSRQQNSLIFEELLTFGGIDSKAISSLIIKKII |

TABLE 1-continued

Exemplary, non-limiting BoNT amino acid sequences

| SEQ ID NO | Description | Sequence |
|---|---|---|
| | | ETAKNNYTTLISERLNTVTVENDLLKYIKNKIPVQGRLGNFKLDTAEFEKKLNTIL FVLNESNLAQRFSILVRKHYLKERPIDPIYVNILDDNSYSTLEGFNISSQGSNDFQG QLLESSYFEKIESNALRAFIKICPRNGLLYNAIYRNSKNYLNNIDLEDKKTTSKTNV SYPCSLLNGCIEVENKDLFLISNKDSLNDINLSEEKIKPETTVFFKDKLPPQDITLSN YDFTEANSIPSISQQNILERNEELYEPIRNSLFEIKTIYVDKLTTFHFLEAQNIDESIDS SKIRVELTDSVDEALSNPNKVYSPFKNMSNTINSIETGITSTYIFYQWLRSIVKDFS DETGKIDVIDKSSDTLAIVPYIGPLLNIGNDIRHGDFVGAIELAGITALLEYVPEFTIP ILVGLEVIGGELAREQVEAIVNNALDKRDQKWAEVYNITKAQWWGTIHLQINTR LAHTYKALSRQANAIKMNMEFQLANYKGNIDDKAKIKNAISETEILLNKSVEQA MKNTEKFMIKLSNSYLTKEMIPKVQDNLKNFDLETKKTLDKFIKEKEDILGTNLSS SLRRKVSIRLNKNIAFDINDIPFSEFDDLINQYKNEI |
| 95 | BoNT/X-LC-$H_N$ H231Y | MKLEINKFNYNDPIDGINVITMRPPRHSDKINKGKGPFKAFQVIKNIWIVPERYNFT NNTNDLNIPSEPIMEADAIYNPNYLNTPSEKDEFLQGVIKVLERIKSKPEGEKLLEL ISSSIPLPLVSNGALTLSDNETIAYQENNNIVSNLQANLVIYGPGPDIANNATYGLY STPISNGEGTLSEVSFSPFYLKPFDESYGNYRSLVNIVNKFVKREFAPDPASTLMHE LVYVTHNLYGISNRNFYYNFDTGKIETSRQQNSLIFEELLTFGGIDSKAISSLIIKKII ETAKNNYTTLISERLNTVTVENDLLKYIKNKIPVQGRLGNFKLDTAEFEKKLNTIL FVLNESNLAQRFSILVRKHYLKERPIDPIYVNILDDNSYSTLEGFNISSQGSNDFQG QLLESSYFEKIESNALRAFIKICPRNGLLYNAIYRNSKNYLNNIDLEDKKTTSKTNV SYPCSLLNGCIEVENKDLFLISNKDSLNDINLSEEKIKPETTVFFKDKLPPQDITLSN YDFTEANSIPSISQQNILERNEELYEPIRNSLFEIKTIYVDKLTTFHFLEAQNIDESIDS SKIRVELTDSVDEALSNPNKVYSPFKNMSNTINSIETGITSTYIFYQWLRSIVKDFS DETGKIDVIDKSSDTLAIVPYIGPLLNIGNDIRHGDFVGAIELAGITALLEYVPEFTIP ILVGLEVIGGELAREQVEAIVNNALDKRDQKWAEVYNITKAQWWGTIHLQINTR LAHTYKALSRQANAIKMNMEFQLANYKGNIDDKAKIKNAISETEILLNKSVEQA MKNTEKFMIKLSNSYLTKEMIPKVQDNLKNFDLETKKTLDKFIKEKEDILGTNLSS SLRRKVSIRLNKNIAFDINDIPFSEFDDLINQYKNEI |
| 96 | BoNT/X-LC-$H_N$-LPETGG | MKLEINKFNYNDPIDGINVITMRPPRHSDKINKGKGPFKAFQVIKNIWIVPERYNFT NNTNDLNIPSEPIMEADAIYNPNYLNTPSEKDEFLQGVIKVLERIKSKPEGEKLLEL ISSSIPLPLVSNGALTLSDNETIAYQENNNIVSNLQANLVIYGPGPDIANNATYGLY STPISNGEGTLSEVSFSPFYLKPFDESYGNYRSLVNIVNKFVKREFAPDPASTLMHE LVHVTHNLYGISNRNFYYNFDTGKIETSRQQNSLIFEELLTFGGIDSKAISSLIIKKII ETAKNNYTTLISERLNTVTVENDLLKYIKNKIPVQGRLGNFKLDTAEFEKKLNTIL FVLNESNLAQRFSILVRKHYLKERPIDPIYVNILDDNSYSTLEGFNISSQGSNDFQG QLLESSYFEKIESNALRAFIKICPRNGLLYNAIYRNSKNYLNNIDLEDKKTTSKTNV SYPCSLLNGCIEVENKDLFLISNKDSLNDINLSEEKIKPETTVFFKDKLPPQDITLSN YDFTEANSIPSISQQNILERNEELYEPIRNSLFEIKTIYVDKLTTFHFLEAQNIDESIDS SKIRVELTDSVDEALSNPNKVYSPFKNMSNTINSIETGITSTYIFYQWLRSIVKDFS DETGKIDVIDKSSDTLAIVPYIGPLLNIGNDIRHGDFVGAIELAGITALLEYVPEFTIP ILVGLEVIGGELAREQVEAIVNNALDKRDQKWAEVYNITKAQWWGTIHLQINTR LAHTYKALSRQANAIKMNMEFQLANYKGNIDDKAKIKNAISETEILLNKSVEQA MKNTEKFMIKLSNSYLTKEMIPKVQDNLKNFDLETKKTLDKFIKEKEDILGTNLSS SLRRKVSIRLNKNIAFDINDIPFSEFDDLINQYKNEILPETGG |
| 97 | G-BoNT/X-Hc | GEDYEVLNLGAEDGKIKDLSGTTSDINIGSDIELADGRENKAIKIKGSENSTIKIAM NKYLRFSATDNFSISFWIKHPKPTNLLNNGIEYTLVENFNQRGWKISIQDSKLIWY LRDHNNSIKIVTPDYIAFNGWNLITITNNRSKGSIVYVNGSKIEEKDISSIWNTEVD DPIIFRLKNNRDTQAFTLLDQFSIYRKELNQNEVVKLYNYYFNSNYIRDIWGNPLQ YNKKYYLQTQDKPGKGLIREYWSSFGYDYVILSDSKTITFPNNIRYGALYNGSKV LIKNSKKLDGLVRNKDFIQLEIDGYNMGISADRFNEDTNYIGTTYGTTHDLTTDFE IIQRQEKYRNYCQLKTPYNIFHKSGLMSTETSKPTFHDYRDWVYSSAWYFQNYE NLNLRKHTKTNWYFIPKDEGWDED |
| 98 | BoNT/A1-Hc | IINTSILNLRYESNHLIDLSRYASKINIGSKVNFDPIDKNQIQLFNLESSKIEVILKNAI VYNSMYENFSTSFWIRIPKYFNSISLNNEYTIINCMENNSGWKVSLNYGEIIWTLQ DTQEIKQRVVFKYSQMINISDYINRWIFVTITNNRLNNSKIYINGRLIDQKPISNLGN IHASNNIMFKLDGCRDTHRYIWIKYFNLFDKELNEKEIKDLYDNQSNSGILKDFW GDYLQYDKPYYMLNLYDPNKYVDVNNVGIRGYMYLKGPRGSVMTTNIYLNSSL YRGTKFIIKKYASGNKDNIVRNNDRVYINVVVKNKEYRLATNASQAGVEKILSAL EIPDVGNLSQVVVMKSKNDQGITNKCKMNLQDNNGNDIGFIGFHQFNNIAKLVA SNWYNRQIERSSRTLGCSWEFIPVDDGWGERPL |
| 99 | BoNT/B1-Hc | ILNNIILNLRYKDNNLIDLSGYGAKVEVYDGVELNDKNQFKLTSSANSKIRVTQN QNIIFNSVFLDFSVSFWIRIPKYKNDGIQNYIHNEYTIINCMKNNSGWKISIRGNRII WTLIDINGKTKSVFFEYNIREDISEYINRWFFVTITNNLNNAKIYINGKLESNTDIKD IREVIANGEIIFKLDGDIDRTQFIWMKYFSIFNTELSQSNIEERYKIQSYSEYLKDFW GNPLMYNKEYYMFNAGNKNSYIKLKKDSPVGEILTRSKYNQNSKYINYRDLYIG EKFIIRRKSNSQSINDDIVRKEDYIYLDFFNLNQEWRVYTYKYFKKEEEKLFLAPIS DSDEFYNTIQIKEYDEQPTYSCQLLFKKDEESTDEIGLIGIHRFYESGIVFEEYKDYF CISKWYLKEVKRKPYNLKLGCNWQFIPKDEGWTE |

TABLE 1-continued

Exemplary, non-limiting BoNT amino acid sequences

| SEQ ID NO | Description | Sequence |
|---|---|---|
| 100 | BoNT/C1-Hc | INDSKILSLQNRKNTLVDTSGYNAEVSEEGDVQLNPIFPFDFKLGSSGEDRGKVIV TQNENIVYNSMYESFSISFWIRINKWVSNLPGYTIIDSVKNNSGWSIGIISNFLVFTL KQNEDSEQSINFSYDISNNAPGYNKWFFVTVTNNMMGNMKIYINGKLIDTIKVKE LTGINFSKTITFEINKIPDTGLITSDSDNINMWIRDFYIFAKELDGKDINILFNSLQYT NVVKDYWGNDLRYNKEYYMVNIDYLNRYMYANSRQIVFNTRRNNNDFNEGYK IIIKRIRGNTNDTRVRGGDILYFDMTINNKAYNLFMKNETMYADNHSTEDIYAIGL REQTKDINDNIIFQIQPMNNTYYYASQIFKSNFNGENISGICSIGTYRFRLGGDWYR HNYLVPTVKQGNYASLLESTSTHWGFVPVSE |
| 101 | BoNT/EN-LC-$H_N$ with modified linker containing thrombin cleavage site | MVTINDLHYSDPIDEDNIINMRIPLYDLEVDDQFINHNVPDLKAFQVFPNVWV VPERYTFYSTMKNLDAPANPSRSSYYDPTYLQSDAEKEVFLQQMILLFKRINS TQEGQQFLNLLSRSIPVPYESNGDVAMGTTQVIKQMDDKGNVLKHRRAHIIIY GPGPDLMAKGSKALTKSRETGRGCMAEIYFSPMYHKTYSTKLTNKNSLVDK SVQEFVPDPAVTLIHELCHGLHALYGIDLGNVGSWEFNSNPNSLFSSWFSSKE AVNFEEVMTFGGEDVKVIKSEIDKKIPGILNLIKTTVEPIINKITDPHDEMLQCL QSKYPSLKGTLGQFFFDDTQLEKDIRDLWMVMNETMFAENLKALTRARYLV PKVENIVQVDILSPNVYTIDKGFNHLSKGFKGQSVSQSYFRKISALARGAVVR ACPNPHFSSQLVPRGSLSSCIEILEDDLFIMSSKDSFTDTDFSEPSVGPVSYKAK KGADTILDSTLSNYDFSKEINFTSTVPIITVEDPLETDEDVPVISEDRTVYVDDY TTFHFLEAQKIGKEVVPTQTKVVFTTNMEEALFDSKKVYTVFENTASRINEAG TGIANGMMFYQWLKGIVQDFTEEATQKDTFDKISDVTMIVPYLGNILNIGNDI RKGDFMGAVELGGVTILLEAIPELTLPVLIGLTIIEDELEKEQVSQTVYNVLDK RDEKWEEVYGFVKQQWWWMVHTQFETRILHAYQALNHQVEAIKANMTYQ LANYRGNQEDKELLEKAIDDTLQSLYYAVDQAMHNIKRFLIQSSKSYLLNQM LPKTKEQLLAFDQQTLRNVNDFINKNQGVLGESLAKDLKKKVEKRLTSLPVF NLEDLPISEFEDLIHSHEIDI |
| 102 | BoNT/EN-LC-$H_N$ with BoNT/A linker | MVTINDLHYSDPIDEDNIINMRIPLYDLEVDDQFINHNVPDLKAFQVFPNVWV VPERYTFYSTMKNLDAPANPSRSSYYDPTYLQSDAEKEVFLQQMILLFKRINS TQEGQQFLNLLSRSIPVPYESNGDVAMGTTQVIKQMDDKGNVLKHRRAHIIIY GPGPDLMAKGSKALTKSRETGRGCMAEIYFSPMYHKTYSTKLTNKNSLVDK SVQEFVPDPAVTLIHELCHGLHALYGIDLGNVGSWEFNSNPNSLFSSWFSSKE AVNFEEVMTFGGEDVKVIKSEIDKKIPGILNLIKTTVEPIINKITDPHDEMLQCL QSKYPSLKGTLGQFFFDDTQLEKDIRDLWMVMNETMFAENLKALTRARYLV PKVENIVQVDILSPNVYTIDKGFNHLSKGFKGQSVSQSYFRKISALARGAVVR ACVRGIITSKTKSLDKGYNKALNDLCIEILEDDLFIMSSKDSFTDTDFSEPSVGP VSYKAKKGADTILDSTLSNYDFSKEINFTSTVPIITVEDPLETDEDVPVISEDRT VYVDDYTTFHFLEAQKIGKEVVPTQTKVVFTTNMEEALFDSKKVYTVFENTA SRINEAGTGIANGMMFYQWLKGIVQDFTEEATQKDTFDKISDVTMIVPYLGNI LNIGNDIRKGDFMGAVELGGVTILLEAIPELTLPVLIGLTIIEDELEKEQVSQTV YNVLDKRDEKWEEVYGFVKQQWWWMVHTQFETRILHAYQALNHQVEAIK ANMTYQLANYRGNQEDKELLEKAIDDTLQSLYYAVDQAMHNIKRFLIQSSKS YLLNQMLPKTKEQLLAFDQQTLRNVNDFINKNQGVLGESLAKDLKKKVEKR LTSLPVFNLEDLPISEFEDLIHSHEIDI |
| 103 | BoNT/EN-LC-$H_N$ with BoNT/B linker | MVTINDLHYSDPIDEDNIINMRIPLYDLEVDDQFINHNVPDLKAFQVFPNVWV VPERYTFYSTMKNLDAPANPSRSSYYDPTYLQSDAEKEVFLQQMILLFKRINS TQEGQQFLNLLSRSIPVPYESNGDVAMGTTQVIKQMDDKGNVLKHRRAHIIIY GPGPDLMAKGSKALTKSRETGRGCMAEIYFSPMYHKTYSTKLTNKNSLVDK SVQEFVPDPAVTLIHELCHGLHALYGIDLGNVGSWEFNSNPNSLFSSWFSSKE AVNFEEVMTFGGEDVKVIKSEIDKKIPGILNLIKTTVEPIINKITDPHDEMLQCL QSKYPSLKGTLGQFFFDDTQLEKDIRDLWMVMNETMFAENLKALTRARYLV PKVENIVQVDILSPNVYTIDKGFNHLSKGFKGQSVSQSYFRKISALARGAVVR ACKSVKAPGICIEILEDDLFIMSSKDSFTDTDFSEPSVGPVSYKAKKGADTILDS TLSNYDFSKEINFTSTVPIITVEDPLETDEDVPVISEDRTVYVDDYTTFHFLEAQ KIGKEVVPTQTKVVFTTNMEEALFDSKKVYTVFENTASRINEAGTGIANGMM FYQWLKGIVQDFTEEATQKDTFDKISDVTMIVPYLGNILNIGNDIRKGDFMGA VELGGVTILLEAIPELTLPVLIGLTIIEDELEKEQVSQTVYNVLDKRDEKWEEV YGFVKQQWWWMVHTQFETRILHAYQALNHQVEAIKANMTYQLANYRGNQ EDKELLEKAIDDTLQSLYYAVDQAMHNIKRFLIQSSKSYLLNQMLPKTKEQL LAFDQQTLRNVNDFINKNQGVLGESLAKDLKKKVEKRLTSLPVFNLEDLPISE FEDLIHSHEIDI |
| 104 | BoNT/EN-LC-$H_N$ with BoNT/C linker | MVTINDLHYSDPIDEDNIINMRIPLYDLEVDDQFINHNVPDLKAFQVFPNVWV VPERYTFYSTMKNLDAPANPSRSSYYDPTYLQSDAEKEVFLQQMILLFKRINS TQEGQQFLNLLSRSIPVPYESNGDVAMGTTQVIKQMDDKGNVLKHRRAHIIIY GPGPDLMAKGSKALTKSRETGRGCMAEIYFSPMYHKTYSTKLTNKNSLVDK SVQEFVPDPAVTLIHELCHGLHALYGIDLGNVGSWEFNSNPNSLFSSWFSSKE AVNFEEVMTFGGEDVKVIKSEIDKKIPGILNLIKTTVEPIINKITDPHDEMLQCL QSKYPSLKGTLGQFFFDDTQLEKDIRDLWMVMNETMFAENLKALTRARYLV PKVENIVQVDILSPNVYTIDKGFNHLSKGFKGQSVSQSYFRKISALARGAVVR ACHKAIDGRSLYNKTLDCIEILEDDLFIMSSKDSFTDTDFSEPSVGPVSYKAKK GADTILDSTLSNYDFSKEINFTSTVPIITVEDPLETDEDVPVISEDRTVYVDDYT |

TABLE 1-continued

Exemplary, non-limiting BoNT amino acid sequences

| SEQ ID NO | Description | Sequence |
|---|---|---|
| | | TFHFLEAQKIGKEVVPTQTKVVFTTNMEEALFDSKKVYTVFENTASRINEAGT<br>GIANGMMFYQWLKGIVQDFTEEATQKDTFDKISDVTMIVPYLGNILNIGNDIR<br>KGDFMGAVELGGVTILLEAIPELTLPVLIGLTIIEDELEKEQVSQTVYNVLDKR<br>DEKWEEVYGFVKQQWWWMVHTQFETRILHAYQALNHQVEAIKANMTYQL<br>ANYRGNQEDKELLEKAIDDTLQSLYYAVDQAMHNIKRFLIQSSKSYLLNQML<br>PKTKEQLLAFDQQTLRNVNDFINKNQGVLGESLAKDLKKKVEKRLTSLPVFN<br>LEDLPISEFEDLIHSHEIDI |
| 105 | BoNT/EN-LC-$H_N$ with BoNT/D linker | MVTINDLHYSDPIDEDNIINMRIPLYDLEVDDQFINHNVPDLKAFQVFPNVWV<br>VPERYTFYSTMKNLDAPANPSRSSYYDPTYLQSDAEKEVFLQQMILLFKRINS<br>TQEGQQFLNLLSRSIPVPYESNGDVAMGTTQVIKQMDDKGNVLKHRRAHIIIY<br>GPGPDLMAKGSKALTKSRETGRGCMAEIYFSPMYHKTYSTKLTNKNSLVDK<br>SVQEFVPDPAVTLIHELCHGLHALYGIDLGNVGSWEFNSNPNSLFSSWFSSKE<br>AVNFEEVMTFGGEDVKVIKSEIDKKIPGILNLIKTTVEPIINKITDPHDEMLQCL<br>QSKYPSLKGTLGQFFFDDTQLEKDIRDLWMVMNETMFAENLKALTRARYLV<br>PKVENIVQVDILSPNVYTIDKGFNHLSKGFKGQSVSQSYFRKISALARGAVVR<br>ACLRLTKNSRDDSTCIEILEDDLFIMSSKDSFTDTDFSEPSVGPVSYKAKKGAD<br>TILDSTLSNYDFSKEINFTSTVPIITVEDPLETDEDVPVISEDRTVYVDDYTTFHF<br>LEAQKIGKEVVPTQTKVVFTTNMEEALFDSKKVYTVFENTASRINEAGTGIAN<br>GMMFYQWLKGIVQDFTEEATQKDTFDKISDVTMIVPYLGNILNIGNDIRKGD<br>FMGAVELGGVTILLEAIPELTLPVLIGLTIIEDELEKEQVSQTVYNVLDKRDEK<br>WEEVYGFVKQQWWWMVHTQFETRILHAYQALNHQVEAIKANMTYQLANY<br>RGNQEDKELLEKAIDDTLQSLYYAVDQAMHNIKRFLIQSSKSYLLNQMLPKT<br>KEQLLAFDQQTLRNVNDFINKNQGVLGESLAKDLKKKVEKRLTSLPVFNLED<br>LPISEFEDLIHSHEIDI |
| 106 | BoNT/EN-LC-$H_N$ with BoNT/E linker | MVTINDLHYSDPIDEDNIINMRIPLYDLEVDDQFINHNVPDLKAFQVFPNVWV<br>VPERYTFYSTMKNLDAPANPSRSSYYDPTYLQSDAEKEVFLQQMILLFKRINS<br>TQEGQQFLNLLSRSIPVPYESNGDVAMGTTQVIKQMDDKGNVLKHRRAHIIIY<br>GPGPDLMAKGSKALTKSRETGRGCMAEIYFSPMYHKTYSTKLTNKNSLVDK<br>SVQEFVPDPAVTLIHELCHGLHALYGIDLGNVGSWEFNSNPNSLFSSWFSSKE<br>AVNFEEVMTFGGEDVKVIKSEIDKKIPGILNLIKTTVEPIINKITDPHDEMLQCL<br>QSKYPSLKGTLGQFFFDDTQLEKDIRDLWMVMNETMFAENLKALTRARYLV<br>PKVENIVQVDILSPNVYTIDKGFNHLSKGFKGQSVSQSYFRKISALARGAVVR<br>ACKNIVSVKGIRKSICIEILEDDLFIMSSKDSFTDTDFSEPSVGPVSYKAKKGAD<br>TILDSTLSNYDFSKEINFTSTVPIITVEDPLETDEDVPVISEDRTVYVDDYTTFHF<br>LEAQKIGKEVVPTQTKVVFTTNMEEALFDSKKVYTVFENTASRINEAGTGIAN<br>GMMFYQWLKGIVQDFTEEATQKDTFDKISDVTMIVPYLGNILNIGNDIRKGD<br>FMGAVELGGVTILLEAIPELTLPVLIGLTIIEDELEKEQVSQTVYNVLDKRDEK<br>WEEVYGFVKQQWWWMVHTQFETRILHAYQALNHQVEAIKANMTYQLANY<br>RGNQEDKELLEKAIDDTLQSLYYAVDQAMHNIKRFLIQSSKSYLLNQMLPKT<br>KEQLLAFDQQTLRNVNDFINKNQGVLGESLAKDLKKKVEKRLTSLPVFNLED<br>LPISEFEDLIHSHEIDI |
| 107 | BoNT/EN-LC-$H_N$ with BoNT/F linker | MVTINDLHYSDPIDEDNIINMRIPLYDLEVDDQFINHNVPDLKAFQVFPNVWV<br>VPERYTFYSTMKNLDAPANPSRSSYYDPTYLQSDAEKEVFLQQMILLFKRINS<br>TQEGQQFLNLLSRSIPVPYESNGDVAMGTTQVIKQMDDKGNVLKHRRAHIIIY<br>GPGPDLMAKGSKALTKSRETGRGCMAEIYFSPMYHKTYSTKLTNKNSLVDK<br>SVQEFVPDPAVTLIHELCHGLHALYGIDLGNVGSWEFNSNPNSLFSSWFSSKE<br>AVNFEEVMTFGGEDVKVIKSEIDKKIPGILNLIKTTVEPIINKITDPHDEMLQCL<br>QSKYPSLKGTLGQFFFDDTQLEKDIRDLWMVMNETMFAENLKALTRARYLV<br>PKVENIVQVDILSPNVYTIDKGFNHLSKGFKGQSVSQSYFRKISALARGAVVR<br>ACKSVIPRKGTKAPPRLCIEILEDDLFIMSSKDSFTDTDFSEPSVGPVSYKAKK<br>GADTILDSTLSNYDFSKEINFTSTVPIITVEDPLETDEDVPVISEDRTVYVDDYT<br>TFHFLEAQKIGKEVVPTQTKVVFTTNMEEALFDSKKVYTVFENTASRINEAGT<br>GIANGMMFYQWLKGIVQDFTEEATQKDTFDKISDVTMIVPYLGNILNIGNDIR<br>KGDFMGAVELGGVTILLEAIPELTLPVLIGLTIIEDELEKEQVSQTVYNVLDKR<br>DEKWEEVYGFVKQQWWWMVHTQFETRILHAYQALNHQVEAIKANMTYQL<br>ANYRGNQEDKELLEKAIDDTLQSLYYAVDQAMHNIKRFLIQSSKSYLLNQML<br>PKTKEQLLAFDQQTLRNVNDFINKNQGVLGESLAKDLKKKVEKRLTSLPVFN<br>LEDLPISEFEDLIHSHEIDI |
| 108 | BoNT/EN-LC-$H_N$ with BoNT/G linker | MVTINDLHYSDPIDEDNIINMRIPLYDLEVDDQFINHNVPDLKAFQVFPNVWV<br>VPERYTFYSTMKNLDAPANPSRSSYYDPTYLQSDAEKEVFLQQMILLFKRINS<br>TQEGQQFLNLLSRSIPVPYESNGDVAMGTTQVIKQMDDKGNVLKHRRAHIIIY<br>GPGPDLMAKGSKALTKSRETGRGCMAEIYFSPMYHKTYSTKLTNKNSLVDK<br>SVQEFVPDPAVTLIHELCHGLHALYGIDLGNVGSWEFNSNPNSLFSSWFSSKE<br>AVNFEEVMTFGGEDVKVIKSEIDKKIPGILNLIKTTVEPIINKITDPHDEMLQCL<br>QSKYPSLKGTLGQFFFDDTQLEKDIRDLWMVMNETMFAENLKALTRARYLV<br>PKVENIVQVDILSPNVYTIDKGFNHLSKGFKGQSVSQSYFRKISALARGAVVR<br>ACKPVMYKNTGKSEQCIEILEDDLFIMSSKDSFTDTDFSEPSVGPVSYKAKKG<br>ADTILDSTLSNYDFSKEINFTSTVPIITVEDPLETDEDVPVISEDRTVYVDDYTT<br>FHFLEAQKIGKEVVPTQTKVVFTTNMEEALFDSKKVYTVFENTASRINEAGT<br>GIANGMMFYQWLKGIVQDFTEEATQKDTFDKISDVTMIVPYLGNILNIGNDIR |

TABLE 1-continued

| Exemplary, non-limiting BoNT amino acid sequences | | |
|---|---|---|
| SEQ ID NO | Description | Sequence |
| | | KGDFMGAVELGGVTILLEAIPELTLPVLIGLTIIEDELEKEQVSQTVYNVLDKR<br>DEKWEEVYGFVKQQWWWMVHTQFETRILHAYQALNHQVEAIKANMTYQL<br>ANYRGNQEDKELLEKAIDDTLQSLYYAVDQAMHNIKRFLIQSSKSYLLNQML<br>PKTKEQLLAFDQQTLRNVNDFINKNQGVLGESLAKDLKKKVEKRLTSLPVFN<br>LEDLPISEFEDLIHSHEIDI |
| 109 | BoNT/EN-LC-$H_N$ with BoNT/X linker | MVTINDLHYSDPIDEDNIINMRIPLYDLEVDDQFINHNVPDLKAFQVFPNVWV<br>VPERYTFYSTMKNLDAPANPSRSSYYDPTYLQSDAEKEVFLQQMILLFKRINS<br>TQEGQQFLNLLSRSIPVPYESNGDVAMGTTQVIKQMDDKGNVLKHRRAHIIIY<br>GPGPDLMAKGSKALTKSRETGRGCMAEIYFSPMYHKTYSTKLTNKNSLVDK<br>SVQEFVPDPAVTLIHELCHGLHALYGIDLGNVGSWEFNSNPNSLFSSWFSSKE<br>AVNFEEVMTFGGEDVKVIKSEIDKKIPGILNLIKTTVEPIINKITDPHDEMLQCL<br>QSKYPSLKGTLGQFFFDDTQLEKDIRDLWMVMNETMFAENLKALTRARYLV<br>PKVENIVQVDILSPNVYTIDKGFNHLSKGFKGQSVSQSYFRKISALARGAVVR<br>ACPRNGLLYNAIYRNSKNYLNNIDLEDKKTTSKTNVSYPCSLLNGCIEILEDD<br>LFIMSSKDSFTDTDFSEPSVGPVSYKAKKGADTILDSTLSNYDFSKEINFTSTVP<br>IITVEDPLETDEDVPVISEDRTVYVDDYTTFHFLEAQKIGKEVVPTQTKVVFTT<br>NMEEALFDSKKVYTVFENTASRINEAGTGIANGMMFYQWLKGIVQDFTEEA<br>TQKDTFDKISDVTMIVPYLGNILNIGNDIRKGDFMGAVELGGVTILLEAIPELT<br>LPVLIGLTIIEDELEKEQVSQTVYNVLDKRDEKWEEVYGFVKQQWWWMVHT<br>QFETRILHAYQALNHQVEAIKANMTYQLANYRGNQEDKELLEKAIDDTLQSL<br>YYAVDQAMHNIKRFLIQSSKSYLLNQMLPKTKEQLLAFDQQTLRNVNDFINK<br>NQGVLGESLAKDLKKKVEKRLTSLPVFNLEDLPISEFEDLIHSHEIDI |
| 110 | BoNT/ENfull length with modified linker containing thrombin cleavage site | MVTINDLHYSDPIDEDNIINMRIPLYDLEVDDQFINHNVPDLKAFQVFPNVWV<br>VPERYTFYSTMKNLDAPANPSRSSYYDPTYLQSDAEKEVFLQQMILLFKRINS<br>TQEGQQFLNLLSRSIPVPYESNGDVAMGTTQVIKQMDDKGNVLKHRRAHIIIY<br>GPGPDLMAKGSKALTKSRETGRGCMAEIYFSPMYHKTYSTKLTNKNSLVDK<br>SVQEFVPDPAVTLIHELCHGLHALYGIDLGNVGSWEFNSNPNSLFSSWFSSKE<br>AVNFEEVMTFGGEDVKVIKSEIDKKIPGILNLIKTTVEPIINKITDPHDEMLQCL<br>QSKYPSLKGTLGQFFFDDTQLEKDIRDLWMVMNETMFAENLKALTRARYLV<br>PKVENIVQVDILSPNVYTIDKGFNHLSKGFKGQSVSQSYFRKISALARGAVVR<br>ACPNPHFSSQLVPRGSLSSCIEILEDDLFIMSSKDSFTDTDFSEPSVGPVSYKAK<br>KGADTILDSTLSNYDFSKEINFTSTVPIITVEDPLETDEDVPVISEDRTVYVDDY<br>TTFHFLEAQKIGKEVVPTQTKVVFTTNMEEALFDSKKVYTVFENTASRINEAG<br>TGIANGMMFYQWLKGIVQDFTEEATQKDTFDKISDVTMIVPYLGNILNIGNDI<br>RKGDFMGAVELGGVTILLEAIPELTLPVLIGLTIIEDELEKEQVSQTVYNVLDK<br>RDEKWEEVYGFVKQQWWWMVHTQFETRILHAYQALNHQVEAIKANMTYQ<br>LANYRGNQEDKELLEKAIDDTLQSLYYAVDQAMHNIKRFLIQSSKSYLLNQM<br>LPKTKEQLLAFDQQTLRNVNDFINKNQGVLGESLAKDLKKKVEKRLTSLPVF<br>NLEDLPISEFEDLIHSHEIDIQDSEVLNIGVNNGKIQDLSGENTPLTLGENLHIV<br>NGRDNQAVRLNNQLDSKLEIQSRPNIHFTAFEDFSISIWIRCSMLRNNRNRGQ<br>KYTIIQQFNKYGWQLAIQDSVFVWTLHDTFNNQIQLTSGSALTNKNYLLQNF<br>WLHITVTNKRSEKSRLYINGVLQDQKDISVLGNCHPKEPILFSIQDNSDPNYFV<br>RPE,QPNVYRKALTDSEVNRLYWKYFEGSYLRDVWGERLTYNRDYYMQLST<br>LPGRGIKREYRTWSGFDYIILSELGTQKIPTHEVTYPKLYQGQKITIHSDGKNL<br>EPHVKSNKNIRLKIDDFYIGVVNPFKLPEWRPESGAYVVTTYNHAEDLCLYFR<br>TRSSSQSLYYGQLIMNDGRNKSLLNYTLKGSTYWIWSSAWYYENYNTSSKT<br>AGNWYFIPVDEGWKED |
| 111 | BoNT/EN full length with BoNT/A linker | MVTINDLHYSDPIDEDNIINMRIPLYDLEVDDQFINHNVPDLKAFQVFPNVWV<br>VPERYTFYSTMKNLDAPANPSRSSYYDPTYLQSDAEKEVFLQQMILLFKRINS<br>TQEGQQFLNLLSRSIPVPYESNGDVAMGTTQVIKQMDDKGNVLKHRRAHIIIY<br>GPGPDLMAKGSKALTKSRETGRGCMAEIYFSPMYHKTYSTKLTNKNSLVDK<br>SVQEFVPDPAVTLIHELCHGLHALYGIDLGNVGSWEFNSNPNSLFSSWFSSKE<br>AVNFEEVMTFGGEDVKVIKSEIDKKIPGILNLIKTTVEPIINKITDPHDEMLQCL<br>QSKYPSLKGTLGQFFFDDTQLEKDIRDLWMVMNETMFAENLKALTRARYLV<br>PKVENIVQVDILSPNVYTIDKGFNHLSKGFKGQSVSQSYFRKISALARGAVVR<br>A<br>CVRGIITSKTKSLDKGYNKALNDLCIEILEDDLFIMSSKDSFTDTDFSEPSVGPV<br>SYKAKKGADTILDSTLSNYDFSKEINFTSTVPIITVEDPLETDEDVPVISEDRTV<br>YVDDYTTFHFLEAQKIGKEVVPTQTKVVFTTNMEEALFDSKKVYTVFENTAS<br>RINEAGTGIANGMMFYQWLKGIVQDFTEEATQKDTFDKISDVTMIVPYLGNIL<br>NIGNDIRKGDFMGAVELGGVTILLEAIPELTLPVLIGLTIIEDELEKEQVSQTVY<br>NVLDKRDEKWEEVYGFVKQQWWWMVHTQFETRILHAYQALNHQVEAIKA<br>NMTYQLANYRGNQEDKELLEKAIDDTLQSLYYAVDQAMHNIKRFLIQSSKSY<br>LLNQMLPKTKEQLLAFDQQTLRNVNDFINKNQGVLGESLAKDLKKKVEKRL<br>TSLPVFNLEDLPISEFEDLIHSHEIDIQDSEVLNIGVNNGKIQDLSGENTPLTLGE<br>NLHIVNGRDNQAVRLNNQLDSKLEIQSRPNIHFTAFEDFSISIWIRCSMLRNNR<br>NRGQKYTIIQQFNKYGWQLAIQDSVFVWTLHDTFNNQIQLTSGSALTNKNYL<br>LQNFWLHITVTNKRSEKSRLYINGVLQDQKDISVLGNCHPKEPILFSIQDNSDP<br>NYFVRFEQFNVYRKALTDSEVNRLYWKYFEGSYLRDVWGERLTYNRDYYM<br>QLSTLPGRGIKREYRTWSGFDYIILSELGTQKIPTHEVTYPKLYQGQKITIHSDG<br>KNLEPHVKSNKNIRLKIDDFYIGVVNPFKLPEWRPESGAYVVTTYNHAEDLC |

TABLE 1-continued

Exemplary, non-limiting BoNT amino acid sequences

| SEQ ID NO | Description | Sequence |
|---|---|---|
| | | LYFRTRSSSQSLYYGQLIMNDGRNKSLLNYTLKGSTYWIWSSAWYYENYNTS SKTAGNWYFIPVDEGWKED |
| 112 | BoNT/EN full length with BoNT/B linker | MVTINDLHYSDPIDEDNIINMRIPLYDLEVDDQFINHNVPDLKAFQVFPNVWV VPERYTFYSTMKNLDAPANPSRSSYYDPTYLQSDAEKEVFLQQMILLFKRINS TQEGQQFLNLLSRSIPVPYESNGDVAMGTTQVIKQMDDKGNVLKHRRAHIIIY GPGPDLMAKGSKALTKSRETGRGCMAEIYFSPMYHKTYSTKLTNKNSLVDK SVQEFVPDPAVTLIHELCHGLHALYGIDLGNVGSWEFNSNPNSLFSSWFSSKE AVNFEEVMTFGGEDVKVIKSEIDKKIPGILNLIKTTVEPIINKITDPHDEMLQCL QSKYPSLKGTLGQFFFDDTQLEKDIRDLWMVMNETMFAENLKALTRARYLV PKVENIVQVDILSPNVYTIDKGFNHLSKGFKGQSVSQSYFRKISALARGAVVR ACKSVKAPGICIEILEDDLFIMSSKDSFTDTDFSEPSVGPVSYKAKKGADTILDS TLSNYDFSKEINFTSTVPIITVEDPLETDEDVPVISEDRTVYVDDYTTFHFLEAQ KIGKEVVPTQTKVVFTTNMEEALFDSKKVYTVFENTASRINEAGTGIANGMM FYQWLKGIVQDFTEEATQKDTFDKISDVTMIVPYLGNILNIGNDIRKGDFMGA VELGGVTILLEAIPELTLPVLIGLTIIEDELEKEQVSQTVYNVLDKRDEKWEEV YGFVKQQWWWMVHTQFETRILHAYQALNHQVEAIKANMTYQLANYRGNQ EDKELLEKAIDDTLQSLYYAVDQAMHNIKRFLIQSSKSYLLNQMLPKTKEQL LAFDQQTLRNVNDFINKNQGVLGESLAKDLKKKVEKRLTSLPVFNLEDLPISE FEDLIHSHEIDIQDSEVLNIGVNNGKIQDLSGENTPLTLGENLHIVNGRDNQAV RLNNQLDSKLEIQSRPNIHFTAFEDFSISIWIRCSMLRNNRNRGQKYTIIQQFNK YGWQLAIQDSVFVWTLHDTFNNQIQLTSGSALTNKNYLLQNFWLHITVTNKR SEKSRLYINGVLQDQKDISVLGNCHPKEPILFSIQDNSDPNYFVRFEQFNVYRK ALTDSEVNRLYWKYFEGSYLRDVWGERLTYNRDYYMQLSTLPGRGIKREYR TWSGFDYIILSELGTQKIPTHEVTYPKLYQGQKITIHSDGKNLEPHVKSNKNIR LKIDDFYIGVVNPFKLPEWRPESGAYVVTTYNHAEDLCLYFRTRSSSQSLYYG QLIMNDGRNKSLLNYTLKGSTYWIWSSAWYYENYNTSSKTAGNWYFIPVDE GWKED |
| 113 | BoNT/EN full length with BoNT/C linker | MVTINDLHYSDPIDEDNIINMRIPLYDLEVDDQFINHNVPDLKAFQVFPNVWV VPERYTFYSTMKNLDAPANPSRSSYYDPTYLQSDAEKEVFLQQMILLFKRINS TQEGQQFLNLLSRSIPVPYESNGDVAMGTTQVIKQMDDKGNVLKHRRAHIIIY GPGPDLMAKGSKALTKSRETGRGCMAEIYFSPMYHKTYSTKLTNKNSLVDK SVQEFVPDPAVTLIHELCHGLHALYGIDLGNVGSWEFNSNPNSLFSSWFSSKE AVNFEEVMTFGGEDVKVIKSEIDKKIPGILNLIKTTVEPIINKITDPHDEMLQCL QSKYPSLKGTLGQFFFDDTQLEKDIRDLWMVMNETMFAENLKALTRARYLV PKVENIVQVDILSPNVYTIDKGFNHLSKGFKGQSVSQSYFRKISALARGAVVR ACHKAIDGRSLYNKTLDCIEILEDDLFIMSSKDSFTDTDFSEPSVGPVSYKAKK GADTILDSTLSNYDFSKEINFTSTVPIITVEDPLETDEDVPVISEDRTVYVDDYT TFHFLEAQKIGKEVVPTQTKVVFTTNMEEALFDSKKVYTVFENTASRINEAGT GIANGMMFYQWLKGIVQDFTEEATQKDTFDKISDVTMIVPYLGNILNIGNDIR KGDFMGAVELGGVTILLEAIPELTLPVLIGLTIIEDELEKEQVSQTVYNVLDKR DEKWEEVYGFVKQQWWWMVHTQFETRILHAYQALNHQVEAIKANMTYQL ANYRGNQEDKELLEKAIDDTLQSLYYAVDQAMHNIKRFLIQSSKSYLLNQML PKTKEQLLAFDQQTLRNVNDFINKNQGVLGESLAKDLKKKVEKRLTSLPVFN LEDLPISEFEDLIHSHEIDIQDSEVLNIGVNNGKIQDLSGENTPLTLGENLHIVN GRDNQAVRLNNQLDSKLEIQSRPNIHFTAFEDFSISIWIRCSMLRNNRNRGQK YTIIQQFNKYGWQLAIQDSVFVWTLHDTFNNQIQLTSGSALTNKNYLLQNFW LHITVTNKRSEKSRLYINGVLQDQKDISVLGNCHPKEPILFSIQDNSDPNYFVR FEQFNVYRKALTDSEVNRLYWKYFEGSYLRDVWGERLTYNRDYYMQLSTLP GRGIKREYRTWSGFDYIILSELGTQKIPTHEVTYPKLYQGQKITIHSDGKNLEP HVKSNKNIRLKIDDFYIGVVNPFKLPEWRPESGAYVVTTYNHAEDLCLYFRT RSSSQSLYYGQLIMNDGRNKSLLNYTLKGSTYWIWSSAWYYENYNTSSKTA GNWYFIPVDEGWKED |
| 114 | BoNT/EN full length with BoNT/D linker | MVTINDLHYSDPIDEDNIINMRIPLYDLEVDDQFINHNVPDLKAFQVFPNVWV VPERYTFYSTMKNLDAPANPSRSSYYDPTYLQSDAEKEVFLQQMILLFKRINS TQEGQQFLNLLSRSIPVPYESNGDVAMGTTQVIKQMDDKGNVLKHRRAHIIIY GPGPDLMAKGSKALTKSRETGRGCMAEIYFSPMYHKTYSTKLTNKNSLVDK SVQEFVPDPAVTLIHELCHGLHALYGIDLGNVGSWEFNSNPNSLFSSWFSSKE AVNFEEVMTFGGEDVKVIKSEIDKKIPGILNLIKTTVEPIINKITDPHDEMLQCL QSKYPSLKGTLGQFFFDDTQLEKDIRDLWMVMNETMFAENLKALTRARYLV PKVENIVQVDILSPNVYTIDKGFNHLSKGFKGQSVSQSYFRKISALARGAVVR ACLRLTKNSRDDSTCIEILEDDLFIMSSKDSFTDTDFSEPSVGPVSYKAKKGAD TILDSTLSNYDFSKEINFTSTVPIITVEDPLETDEDVPVISEDRTVYVDDYTTFHF LEAQKIGKEVVPTQTKVVFTTNMEEALFDSKKVYTVFENTASRINEAGTGIAN GMMFYQWLKGIVQDFTEEATQKDTFDKISDVTMIVPYLGNILNIGNDIRKGD FMGAVELGGVTILLEAIPELTLPVLIGLTIIEDELEKEQVSQTVYNVLDKRDEK WEEVYGFVKQQWWWMVHTQFETRILHAYQALNHQVEAIKANMTYQLANY RGNQEDKELLEKAIDDTLQSLYYAVDQAMHNIKRFLIQSSKSYLLNQMLPKT KEQLLAFDQQTLRNVNDFINKNQGVLGESLAKDLKKKVEKRLTSLPVFNLED LPISEFEDLIHSHEIDIQDSEVLNIGVNNGKIQDLSGENTPLTLGENLHIVNGRD NQAVRLNNQLDSKLEIQSRPNIHFTAFEDFSISIWIRCSMLRNNRNRGQKYTII QQFNKYGWQLAIQDSVFVWTLHDTFNNQIQLTSGSALTNKNYLLQNFWLHIT |

TABLE 1-continued

Exemplary, non-limiting BoNT amino acid sequences

| SEQ ID NO | Description | Sequence |
|---|---|---|
| | | VTNKRSEKSRLYINGVLQDQKDISVLGNCHPKEPILFSIQDNSDPNYFVRFEQF NVYRKALTDSEVNRLYWKYFEGSYLRDVWGERLTYNRDYYMQLSTLPGRGI KREYRTWSGFDYIILSELGTQKIPTHEVTYPKLYQGQKITIHSDGKNLEPHVKS NKNIRLKIDDFYIGVVNPFKLPEWRPESGAYVVTTYNHAEDLCLYFRTRSSSQ SLYYGQLIMNDGRNKSLLNYTLKGSTYWIWSSAWYYENYNTSSKTAGNWY FIPVDEGWKED |
| 115 | BoNT/EN full length with BoNT/E linker | MVTINDLHYSDPIDEDNIINMRIPLYDLEVDDQFINHNVPDLKAFQVFPNVWV VPERYTFYSTMKNLDAPANPSRSSYYDPTYLQSDAEKEVFLQQMILLFKRINS TQEGQQFLNLLSRSIPVPYESNGDVAMGTTQVIKQMDDKGNVLKHRRAHIIIY GPGPDLMAKGSKALTKSRETGRGCMAEIYFSPMYHKTYSTKLTNKNSLVDK SVQEFVPDPAVTLIHELCHGLHALYGIDLGNVGSWEFNSNPNSLFSSWFSSKE AVNFEEVMTFGGEDVKVIKSEIDKKIPGILNLIKTTVEPIINKITDPHDEMLQCL QSKYPSLKGTLGQFFFDDTQLEKDIRDLWMVMNETMFAENLKALTRARYLV PKVENIVQVDILSPNVYTIDKGFNHLSKGFKGQSVSQSYFRKISALARGAVVR ACKNIVSVKGIRKSICIEILEDDLFIMSSKDSFTDTDFSEPSVGPVSYKAKKGAD TILDSTLSNYDFSKEINFTSTVPIITVEDPLETDEDVPVISEDRTVYVDDYTTFHF LEAQKIGKEVVPTQTKVVFTTNMEEALFDSKKVYTVFENTASRINEAGTGIAN GMMFYQWLKGIVQDFTEEATQKDTFDKISDVTMIVPYLGNILNIGNDIRKGD FMGAVELGGVTILLEAIPELTLPVLIGLTIIEDELEKEQVSQTVYNVLDKRDEK WEEVYGFVKQQWWWMVHTQFETRILHAYQALNHQVEAIKANMTYQLANY RGNQEDKELLEKAIDDTLQSLYYAVDQAMHNIKRFLIQSSKSYLLNQMLPKT KEQLLAFDQQTLRNVNDFINKNQGVLGESLAKDLKKKVEKRLTSLPVFNLED LPISEFEDLIHSHEIDIQDSEVLNIGVNNGKIQDLSGENTPLTLGENLHIVNGRD NQAVRLNNQLDSKLEIQSRPNIHFTAFEDFSISIWIRCSMLRNNRNRGQKYTII QQFNKYGWQLAIQDSVFVWTLHDTFNNQIQLTSGSALTNKNYLLQNFWLHIT VTNKRSEKSRLYINGVLQDQKDISVLGNCHPKEPILFSIQDNSDPNYFVRFEQF NVYRKALTDSEVNRLYWKYFEGSYLRDVWGERLTYNRDYYMQLSTLPGRGI KREYRTWSGFDYIILSELGTQKIPTHEVTYPKLYQGQKITIHSDGKNLEPHVKS NKNIRLKIDDFYIGVVNPFKLPEWRPESGAYVVTTYNHAEDLCLYFRTRSSSQ SLYYGQLIMNDGRNKSLLNYTLKGSTYWIWSSAWYYENYNTSSKTAGNWY FIPVDEGWKED |
| 116 | BoNT/EN full length with BoNT/F linker | MVTINDLHYSDPIDEDNIINMRIPLYDLEVDDQFINHNVPDLKAFQVFPNVWV VPERYTFYSTMKNLDAPANPSRSSYYDPTYLQSDAEKEVFLQQMILLFKRINS TQEGQQFLNLLSRSIPVPYESNGDVAMGTTQVIKQMDDKGNVLKHRRAHIIIY GPGPDLMAKGSKALTKSRETGRGCMAEIYFSPMYHKTYSTKLTNKNSLVDK SVQEFVPDPAVTLIHELCHGLHALYGIDLGNVGSWEFNSNPNSLFSSWFSSKE AVNFEEVMTFGGEDVKVIKSEIDKKIPGILNLIKTTVEPIINKITDPHDEMLQCL QSKYPSLKGTLGQFFFDDTQLEKDIRDLWMVMNETMFAENLKALTRARYLV PKVENIVQVDILSPNVYTIDKGFNHLSKGFKGQSVSQSYFRKISALARGAVVR ACKSVIPRKGTKAPPRLCIEILEDDLFIMSSKDSFTDTDFSEPSVGPVSYKAKK GADTILDSTLSNYDFSKEINFTSTVPIITVEDPLETDEDVPVISEDRTVYVDDYT TFHFLEAQKIGKEVVPTQTKVVFTTNMEEALFDSKKVYTVFENTASRINEAGT GIANGMMFYQWLKGIVQDFTEEATQKDTFDKISDVTMIVPYLGNILNIGNDIR KGDFMGAVELGGVTILLEAIPELTLPVLIGLTIIEDELEKEQVSQTVYNVLDKR DEKWEEVYGFVKQQWWWMVHTQFETRILHAYQALNHQVEAIKANMTYQL ANYRGNQEDKELLEKAIDDTLQSLYYAVDQAMHNIKRFLIQSSKSYLLNQML PKTKEQLLAFDQQTLRNVNDFINKNQGVLGESLAKDLKKKVEKRLTSLPVFN LEDLPISEFEDLIHSHEIDIQDSEVLNIGVNNGKIQDLSGENTPLTLGENLHIVN GRDNQAVRLNNQLDSKLEIQSRPNIHFTAFEDFSISIWIRCSMLRNNRNRGQK YTIIQQFNKYGWQLAIQDSVFVWTLHDTFNNQIQLTSGSALTNKNYLLQNFW LHITVTNKRSEKSRLYINGVLQDQKDISVLGNCHPKEPILFSIQDNSDPNYFVR FEQFNVYRKALTDSEVNRLYWKYFEGSYLRDVWGERLTYNRDYYMQLSTLP GRGIKREYRTWSGFDYIILSELGTQKIPTHEVTYPKLYQGQKITIHSDGKNLEP HVKSNKNIRLKIDDFYIGVVNPFKLPEWRPESGAYVVTTYNHAEDLCLYFRT RSSSQSLYYGQLIMNDGRNKSLLNYTLKGSTYWIWSSAWYYENYNTSSKTA GNWYFIPVDEGWKED |
| 117 | BoNT/EN full length with BoNT/G linker | MVTINDLHYSDPIDEDNIINMRIPLYDLEVDDQFINHNVPDLKAFQVFPNVWV VPERYTFYSTMKNLDAPANPSRSSYYDPTYLQSDAEKEVFLQQMILLFKRINS TQEGQQFLNLLSRSIPVPYESNGDVAMGTTQVIKQMDDKGNVLKHRRAHIIIY GPGPDLMAKGSKALTKSRETGRGCMAEIYFSPMYHKTYSTKLTNKNSLVDK SVQEFVPDPAVTLIHELCHGLHALYGIDLGNVGSWEFNSNPNSLFSSWFSSKE AVNFEEVMTFGGEDVKVIKSEIDKKIPGILNLIKTTVEPIINKITDPHDEMLQCL QSKYPSLKGTLGQFFFDDTQLEKDIRDLWMVMNETMFAENLKALTRARYLV PKVENIVQVDILSPNVYTIDKGFNHLSKGFKGQSVSQSYFRKISALARGAVVR ACKPVMYKNTGKSEQCIEILEDDLFIMSSKDSFTDTDFSEPSVGPVSYKAKKG ADTILDSTLSNYDFSKEINFTSTVPIITVEDPLETDEDVPVISEDRTVYVDDYTT FHFLEAQKIGKEVVPTQTKVVFTTNMEEALFDSKKVYTVFENTASRINEAGT GIANGMMFYQWLKGIVQDFTEEATQKDTFDKISDVTMIVPYLGNILNIGNDIR KGDFMGAVELGGVTILLEAIPELTLPVLIGLTIIEDELEKEQVSQTVYNVLDKR DEKWEEVYGFVKQQWWWMVHTQFETRILHAYQALNHQVEAIKANMTYQL ANYRGNQEDKELLEKAIDDTLQSLYYAVDQAMHNIKRFLIQSSKSYLLNQML |

TABLE 1-continued

Exemplary, non-limiting BoNT amino acid sequences

| SEQ ID NO | Description | Sequence |
|---|---|---|
| | | PKTKEQLLAFDQQTLRNVNDFINKNQGVLGESLAKDLKKKVEKRLTSLPVFN<br>LEDLPISEFEDLIHSHEIDIQDSEVLNIGVNNGKIQDLSGENTPLTLGENLHIVN<br>GRDNQAVRLNNQLDSKLEIQSRPNIHFTAFEDFSISIWIRCSMLRNNRNRGQK<br>YTIIQQFNKYGWQLAIQDSVFVWTLHDTFNNQIQLTSGSALTNKNYLLQNFW<br>LHITVTNKRSEKSRLYINGVLQDQKDISVLGNCHPKEPILFSIQDNSDPNYFVR<br>FEQFNVYRKALTDSEVNRLYWKYFEGSYLRDVWGERLTYNRDYYMQLSTLP<br>GRGIKREYRTWSGFDYIILSELGTQKIPTHEVTYPKLYQGQKITIHSDGKNLEP<br>HVKSNKNIRLKIDDFYIGVVNPFKLPEWRPESGAYVVTTYNHAEDLCLYFRT<br>RSSSQSLYYGQLIMNDGRNKSLLNYTLKGSTYWIWSSAWYYENYNTSSKTA<br>GNWYFIPVDEGWKED |
| 118 | BoNT/EN full length with BoNT/X linker | MVTINDLHYSDPIDEDNIINMRIPLYDLEVDDQFINHNVPDLKAFQVFPNVWV<br>VPERYTFYSTMKNLDAPANPSRSSYYDPTYLQSDAEKEVFLQQMILLFKRINS<br>TQEGQQFLNLLSRSIPVPYESNGDVAMGTTQVIKQMDDKGNVLKHRRAHIIIY<br>GPGPDLMAKGSKALTKSRETGRGCMAEIYFSPMYHKTYSTKLTNKNSLVDK<br>SVQEFVPDPAVTLIHELCHGLHALYGIDLGNVGSWEFNSNPNSLFSSWFSSKE<br>AVNFEEVMTFGGEDVKVIKSEIDKKIPGILNLIKTTVEPIINKITDPHDEMLQCL<br>QSKYPSLKGTLGQFFFDDTQLEKDIRDLWMVMNETMFAENLKALTRARYLV<br>PKVENIVQVDILSPNVYTIDKGFNHLSKGFKGQSVSQSYFRKISALARGAVVR<br>ACPRNGLLYNAIYRNSKNYLNNIDLEDKKTTSKTNVSYPCSLLNGCIEILEDD<br>LFIMSSKDSFTDTDFSEPSVGPVSYKAKKGADTILDSTLSNYDFSKEINFTSTVP<br>IITVEDPLETDEDVPVISEDRTVYVDDYTTFHFLEAQKIGKEVVPTQTKVVFTT<br>NMEEALFDSKKVYTVFENTASRINEAGTGIANGMMFYQWLKGIVQDFTEEA<br>TQKDTFDKISDVTMIVPYLGNILNIGNDIRKGDFMGAVELGGVTILLEAIPELT<br>LPVLIGLTIIEDELEKEQVSQTVYNVLDKRDEKWEEVYGFVKQQWWWMVHT<br>QFETRILHAYQALNHQVEAIKANMTYQLANYRGNQEDKELLEKAIDDTLQSL<br>YYAVDQAMHNIKRFLIQSSKSYLLNQMLPKTKEQLLAFDQQTLRNVNDFINK<br>NQGVLGESLAKDLKKKVEKRLTSLPVFNLEDLPISEFEDLIHSHEIDIQDSEVL<br>NIGVNNGKIQDLSGENTPLTLGENLHIVNGRDNQAVRLNNQLDSKLEIQSRPN<br>IHFTAFEDFSISIWIRCSMLRNNRNRGQKYTIIQQFNKYGWQLAIQDSVFVWTL<br>HDTFNNQIQLTSGSALTNKNYLLQNFWLHITVTNKRSEKSRLYINGVLQDQK<br>DISVLGNCHPKEPILFSIQDNSDPNYFVRFEQFNVYRKALTDSEVNRLYWKYF<br>EGSYLRDVWGERLTYNRDYYMQLSTLPGRGIKREYRTWSGFDYIILSELGTQ<br>KIPTHEVTYPKLYQGQKITIHSDGKNLEPHVKSNKNIRLKIDDFYIGVVNPFKL<br>PEWRPESGAYVVTTYNHAEDLCLYFRTRSSSQSLYYGQLIMNDGRNKSLLNY<br>TLKGSTYWIWSSAWYYENYNTSSKTAGNWYFIPVDEGWKED |
| 119 | BoNT/EN-LC-$H_N$ and BoNT/A1-$H_C$ | MVTINDLHYSDPIDEDNIINMRIPLYDLEVDDQFINHNVPDLKAFQVFPNVWV<br>VPERYTFYSTMKNLDAPANPSRSSYYDPTYLQSDAEKEVFLQQMILLFKRINS<br>TQEGQQFLNLLSRSIPVPYESNGDVAMGTTQVIKQMDDKGNVLKHRRAHIIIY<br>GPGPDLMAKGSKALTKSRETGRGCMAEIYFSPMYHKTYSTKLTNKNSLVDK<br>SVQEFVPDPAVTLIHELCHGLHALYGIDLGNVGSWEFNSNPNSLFSSWFSSKE<br>AVNFEEVMTFGGEDVKVIKSEIDKKIPGILNLIKTTVEPIINKITDPHDEMLQCL<br>QSKYPSLKGTLGQFFFDDTQLEKDIRDLWMVMNETMFAENLKALTRARYLV<br>PKVENIVQVDILSPNVYTIDKGFNHLSKGFKGQSVSQSYFRKISALARGAVVR<br>ACPNPHFSSQRGLSSCIEILEDDLFIMSSKDSFTDTDFSEPSVGPVSYKAKKGA<br>DTILDSTLSNYDFSKEINFTSTVPIITVEDPLETDEDVPVISEDRTVYVDDYTTF<br>HFLEAQKIGKEVVPTQTKVVFTTNMEEALFDSKKVYTVFENTASRINEAGTGI<br>ANGMMFYQWLKGIVQDFTEEATQKDTFDKISDVTMIVPYLGNILNIGNDIRK<br>GDFMGAVELGGVTILLEAIPELTLPVLIGLTIIEDELEKEQVSQTVYNVLDKRD<br>EKWEEVYGFVKQQWWWMVHTQFETRILHAYQALNHQVEAIKANMTYQLA<br>NYRGNQEDKELLEKAIDDTLQSLYYAVDQAMHNIKRFLIQSSKSYLLNQMLP<br>KTKEQLLAFDQQTLRNVNDFINKNQGVLGESLAKDLKKKVEKRLTSLPVFNL<br>EDLPISEFEDLIHSHEIDIIINTSILNLRYESNHLIDLSRYASKINIGSKVNFDPIDK<br>NQIQLFNLESSKIEVILKNAIVYNSMYENFSTSFWIRIPKYFNSISLNNEYTIINC<br>MENNSGWKVSLNYGEIIWTLQDTQEIKQRVVFKYSQMINISDYINRWIFVTIT<br>NNRLNNSKIYINGRLIDQKPISNLGNIHASNNIMFKLDGCRDTHRYIWIKYFNL<br>FDKELNEKEIKDLYDNQSNSGILKDFWGDYLQYDKPYYMLNLYDPNKYVDV<br>NNVGIRGYMYLKGPRGSVMTTNIYLNSSLYRGTKFIIKKYASGNKDNIVRNN<br>DRVYINVVVKNKEYRLATNASQAGVEKILSALEIPDVGNLSQVVVMKSKND<br>QGITNKCKMNLQDNNGNDIGFIGFHQFNNIAKLVASNWYNRQIERSSRTLGC<br>SWEFIPVDDGWGERPL |
| 120 | BoNT/EN-LC-$H_N$ and BoNT/B1-$H_C$ | MVTINDLHYSDPIDEDNIINMRIPLYDLEVDDQFINHNVPDLKAFQVFPNVWV<br>VPERYTFYSTMKNLDAPANPSRSSYYDPTYLQSDAEKEVFLQQMILLFKRINS<br>TQEGQQFLNLLSRSIPVPYESNGDVAMGTTQVIKQMDDKGNVLKHRRAHIIIY<br>GPGPDLMAKGSKALTKSRETGRGCMAEIYFSPMYHKTYSTKLTNKNSLVDK<br>SVQEFVPDPAVTLIHELCHGLHALYGIDLGNVGSWEFNSNPNSLFSSWFSSKE<br>AVNFEEVMTFGGEDVKVIKSEIDKKIPGILNLIKTTVEPIINKITDPHDEMLQCL<br>QSKYPSLKGTLGQFFFDDTQLEKDIRDLWMVMNETMFAENLKALTRARYLV<br>PKVENIVQVDILSPNVYTIDKGFNHLSKGFKGQSVSQSYFRKISALARGAVVR<br>ACPNPHFSSQRGLSSCIEILEDDLFIMSSKDSFTDTDFSEPSVGPVSYKAKKGA<br>DTILDSTLSNYDFSKEINFTSTVPIITVEDPLETDEDVPVISEDRTVYVDDYTTF<br>HFLEAQKIGKEVVPTQTKVVFTTNMEEALFDSKKVYTVFENTASRINEAGTGI |

TABLE 1-continued

Exemplary, non-limiting BoNT amino acid sequences

| SEQ ID NO | Description | Sequence |
| --- | --- | --- |
| | | ANGMMFYQWLKGIVQDFTEEATQKDTFDKISDVTMIVPYLGNILNIGNDIRK<br>GDFMGAVELGGVTILLEAIPELTLPVLIGLTIIEDELEKEQVSQTVYNVLDKRD<br>EKWEEVYGFVKQQWWWMVHTQFETRILHAYQALNHQVEAIKANMTYQLA<br>NYRGNQEDKELLEKAIDDTLQSLYYAVDQAMHNIKRFLIQSSKSYLLNQMLP<br>KTKEQLLAFDQQTLRNVNDFINKNQGVLGESLAKDLKKKVEKRLTSLPVFNL<br>EDLPISEFEDLIHSHEIDIILNNIILNLRYKDNNLIDLSGYGAKVEVYDGVELND<br>KNQFKLTSSANSKIRVTQNQNIIFNSVFLDFSVSFWIRIPKYKNDGIQNYIHNEY<br>TIINCMKNNSGWKISIRGNRIIWTLIDINGKTKSVFFEYNIREDISEYINRWFFVT<br>ITNNLNNAKIYINGKLESNTDIKDIREVIANGEIIFKLDGDIDRTQFIWMKYFSIF<br>NTELSQSNIEERYKIQSYSEYLKDFWGNPLMYNKEYYMFNAGNKNSYIKLKK<br>DSPVGEILTRSKYNQNSKYINYRDLYIGEKFIIRRKSNSQSINDDIVRKEDYIYL<br>DFFNLNQEWRVYTYKYFKKEEEKLFLAPISDSDEFYNTIQIKEYDEQPTYSCQ<br>LLFKKDEESTDEIGLIGIHRFYESGIVFEEYKDYFCISKWYLKEVKRKPYNLKL<br>GCNWQFIPKDEGWTE |
| 121 | BoNT/EN-LC-$H_N$ and BoNT/C1-$H_C$ | MVTINDLHYSDPIDEDNIINMRIPLYDLEVDDQFINHNVPDLKAFQVFPNVWV<br>VPERYTFYSTMKNLDAPANPSRSSYYDPTYLQSDAEKEVFLQQMILLFKRINS<br>TQEGQQFLNLLSRSIPVPYESNGDVAMGTTQVIKQMDDKGNVLKHRRAHIIIY<br>GPGPDLMAKGSKALTKSRETGRGCMAEIYFSPMYHKTYSTKLTNKNSLVDK<br>SVQEFVPDPAVTLIHELCHGLHALYGIDLGNVGSWEFNSNPNSLFSSWFSSKE<br>AVNFEEVMTFGGEDVKVIKSEIDKKIPGILNLIKTTVEPIINKITDPHDEMLQCL<br>QSKYPSLKGTLGQFFFDDTQLEKDIRDLWMVMNETMFAENLKALTRARYLV<br>PKVENIVQVDILSPNVYTIDKGFNHLSKGFKGQSVSQSYFRKISALARGAVVR<br>ACPNPHFSSQRGLSSCIEILEDDLFIMSSKDSFTDTDFSEPSVGPVSYKAKKGA<br>DTILDSTLSNYDFSKEINFTSTVPIITVEDPLETDEDVPVISEDRTVYVDDYTTF<br>HFLEAQKIGKEVVPTQTKVVFTTNMEEALFDSKKVYTVFENTASRINEAGTGI<br>ANGMMFYQWLKGIVQDFTEEATQKDTFDKISDVTMIVPYLGNILNIGNDIRK<br>GDFMGAVELGGVTILLEAIPELTLPVLIGLTIIEDELEKEQVSQTVYNVLDKRD<br>EKWEEVYGFVKQQWWWMVHTQFETRILHAYQALNHQVEAIKANMTYQLA<br>NYRGNQEDKELLEKAIDDTLQSLYYAVDQAMHNIKRFLIQSSKSYLLNQMLP<br>KTKEQLLAFDQQTLRNVNDFINKNQGVLGESLAKDLKKKVEKRLTSLPVFNL<br>EDLPISEFEDLIHSHEIDIINDSKILSLQNRKNTLVDTSGYNAEVSEEGDVQLNPI<br>FPFDFKLGSSGEDRGKVIVTQNENIVYNSMYESFSISFWIRINKWVSNLPGYTII<br>DSVKNNSGWSIGIISNFLVFTLKQNEDSEQSINFSYDISNNAPGYNKWFFVTVT<br>NNMMGNMKIYINGKLIDTIKVKELTGINFSKTITFEINKIPDTGLITSDSDNINM<br>WIRDFYIFAKELDGKDINILFNSLQYTNVVKDYWGNDLRYNKEYYMVNIDYL<br>NRYMYANSRQIVFNTRRNNNDFNEGYKIIIKRIRGNTNDTRVRGGDILYFDMT<br>INNKAYNLFMKNETMYADNHSTEDIYAIGLREQTKDINDNIIFQIQPMNNTYY<br>YASQIFKSNFNGENISGICSIGTYRFRLGGDWYRHNYLVPTVKQGNYASLLES<br>TSTHWGFVPVSE |
| 122 | BoNT/EN-LC-$H_N$ and BoNT/X-$H_C$ | MVTINDLHYSDPIDEDNIINMRIPLYDLEVDDQFINHNVPDLKAFQVFPNVWV<br>VPERYTFYSTMKNLDAPANPSRSSYYDPTYLQSDAEKEVFLQQMILLFKRINS<br>TQEGQQFLNLLSRSIPVPYESNGDVAMGTTQVIKQMDDKGNVLKHRRAHIIIY<br>GPGPDLMAKGSKALTKSRETGRGCMAEIYFSPMYHKTYSTKLTNKNSLVDK<br>SVQEFVPDPAVTLIHELCHGLHALYGIDLGNVGSWEFNSNPNSLFSSWFSSKE<br>AVNFEEVMTFGGEDVKVIKSEIDKKIPGILNLIKTTVEPIINKITDPHDEMLQCL<br>QSKYPSLKGTLGQFFFDDTQLEKDIRDLWMVMNETMFAENLKALTRARYLV<br>PKVENIVQVDILSPNVYTIDKGFNHLSKGFKGQSVSQSYFRKISALARGAVVR<br>ACPNPHFSSQRGLSSCIEILEDDLFIMSSKDSFTDTDFSEPSVGPVSYKAKKGA<br>DTILDSTLSNYDFSKEINFTSTVPIITVEDPLETDEDVPVISEDRTVYVDDYTTF<br>HFLEAQKIGKEVVPTQTKVVFTTNMEEALFDSKKVYTVFENTASRINEAGTGI<br>ANGMMFYQWLKGIVQDFTEEATQKDTFDKISDVTMIVPYLGNILNIGNDIRK<br>GDFMGAVELGGVTILLEAIPELTLPVLIGLTIIEDELEKEQVSQTVYNVLDKRD<br>EKWEEVYGFVKQQWWWMVHTQFETRILHAYQALNHQVEAIKANMTYQLA<br>NYRGNQEDKELLEKAIDDTLQSLYYAVDQAMHNIKRFLIQSSKSYLLNQMLP<br>KTKEQLLAFDQQTLRNVNDFINKNQGVLGESLAKDLKKKVEKRLTSLPVFNL<br>EDLPISEFEDLIHSHEIDIEDYEVLNLGAEDGKIKDLSGTTSDINIGSDIELADGR<br>ENKAIKIKGSENSTIKIAMNKYLRFSATDNFSISFWIKHPKPTNLLNNGIEYTLV<br>ENFNQRGWKISIQDSKLIWYLRDHNNSIKIVTPDYIAFNGWNLITITNNRSKGS<br>IVYVNGSKIEEKDISSIWNTEVDDPIIFRLKNNRDTQAFTLLDQFSIYRKELNQN<br>EVVKLYNYYFNSNYIRDIWGNPLQYNKKYYLQTQDKPGKGLIREYWSSFGY<br>DYVILSDSKTITFPNNIRYGALYNGSKVLIKNSKKLDGLVRNKDFIQLEIDGYN<br>MGISADRFNEDTNYIGTTYGTTHDLTTDFEIIQRQEKYRNYCQLKTPYNIFHKS<br>GLMSTETSKPTFHDYRDWVYSSAWYFQNYENLNLRKHTKTNWYFIPKDEG<br>WDED |
| 123 | BoNT/EN-LC-$H_N$ (with modified linker containing thrombin cleavage site) and BoNT/A1-$H_C$ | MVTINDLHYSDPIDEDNIINMRIPLYDLEVDDQFINHNVPDLKAFQVFPNVWV<br>VPERYTFYSTMKNLDAPANPSRSSYYDPTYLQSDAEKEVFLQQMILLFKRINS<br>TQEGQQFLNLLSRSIPVPYESNGDVAMGTTQVIKQMDDKGNVLKHRRAHIIIY<br>GPGPDLMAKGSKALTKSRETGRGCMAEIYFSPMYHKTYSTKLTNKNSLVDK<br>SVQEFVPDPAVTLIHELCHGLHALYGIDLGNVGSWEFNSNPNSLFSSWFSSKE<br>AVNFEEVMTFGGEDVKVIKSEIDKKIPGILNLIKTTVEPIINKITDPHDEMLQCL<br>QSKYPSLKGTLGQFFFDDTQLEKDIRDLWMVMNETMFAENLKALTRARYLV |

TABLE 1-continued

Exemplary, non-limiting BoNT amino acid sequences

| SEQ ID NO | Description | Sequence |
|---|---|---|
| | | PKVENIVQVDILSPNVYTIDKGFNHLSKGFKGQSVSQSYFRKISALARGAVVR ACPNPHFSSQLVPRGSLSSCIEILEDDLFIMSSKDSFTDTDFSEPSVGPVSYKAK KGADTILDSTLSNYDFSKEINFTSTVPIITVEDPLETDEDVPVISEDRTVYVDDY TTFHFLEAQKIGKEVVPTQTKVVFTTNMEEALFDSKKVYTVFENTASRINEAG TGIANGMMFYQWLKGIVQDFTEEATQKDTFDKISDVTMIVPYLGNILNIGNDI RKGDFMGAVELGGVTILLEAIPELTLPVLIGLTIIEDELEKEQVSQTVYNVLDK RDEKWEEVYGFVKQQWWWMVHTQFETRILHAYQALNHQVEAIKANMTYQ LANYRGNQEDKELLEKAIDDTLQSLYYAVDQAMHNIKRFLIQSSKSYLLNQM LPKTKEQLLAFDQQTLRNVNDFINKNQGVLGESLAKDLKKKVEKRLTSLPVF NLEDLPISEFEDLIHSHEIDIIINTSILNLRYESNHLIDLSRYASKINIGSKVNFDPI DKNQIQLFNLESSKIEVILKNAIVYNSMYENFSTSFWIRIPKYFNSISLNNEYTII NCMENNSGWKVSLNYGEIIWTLQDTQEIKQRVVFKYSQMINISDYINRWIFVT ITNNRLNNSKIYINGRLIDQKPISNLGNIHASNNIMFKLDGCRDTHRYIWIKYF NLFDKELNEKEIKDLYDNQSNSGILKDFWGDYLQYDKPYYMLNLYDPNKYV DVNNVGIRGYMYLKGPRGSVMTTNIYLNSSLYRGTKFIIKKYASGNKDNIVR NNDRVYINVVVKNKEYRLATNASQAGVEKILSALEIPDVGNLSQVVVMKSK NDQGITNKCKMNLQDNNGNDIGFIGFHQFNNIAKLVASNWYNRQIERSSRTL GCSWEFIPVDDGWGERPL |
| 124 | BoNT/EN-LC-$H_N$ (with modified linker containing thrombin cleavage site) and BoNT/B1-$H_C$ | MVTINDLHYSDPIDEDNIINMRIPLYDLEVDDQFINHNVPDLKAFQVFPNVWV VPERYTFYSTMKNLDAPANPSRSSYYDPTYLQSDAEKEVFLQQMILLFKRINS TQEGQQFLNLLSRSIPVPYESNGDVAMGTTQVIKQMDDKGNVLKHRRAHIIIY GPGPDLMAKGSKALTKSRETGRGCMAEIYFSPMYHKTYSTKLTNKNSLVDK SVQEFVPDPAVTLIHELCHGLHALYGIDLGNVGSWEFNSNPNSLFSSWFSSKE AVNFEEVMTFGGEDVKVIKSEIDKKIPGILNLIKTTVEPIINKITDPHDEMLQCL QSKYPSLKGTLGQFFFDDTQLEKDIRDLWMVMNETMFAENLKALTRARYLV PKVENIVQVDILSPNVYTIDKGFNHLSKGFKGQSVSQSYFRKISALARGAVVR ACPNPHFSSQLVPRGSLSSCIEILEDDLFIMSSKDSFTDTDFSEPSVGPVSYKAK KGADTILDSTLSNYDFSKEINFTSTVPIITVEDPLETDEDVPVISEDRTVYVDDY TTFHFLEAQKIGKEVVPTQTKVVFTTNMEEALFDSKKVYTVFENTASRINEAG TGIANGMMFYQWLKGIVQDFTEEATQKDTFDKISDVTMIVPYLGNILNIGNDI RKGDFMGAVELGGVTILLEAIPELTLPVLIGLTIIEDELEKEQVSQTVYNVLDK RDEKWEEVYGFVKQQWWWMVHTQFETRILHAYQALNHQVEAIKANMTYQ LANYRGNQEDKELLEKAIDDTLQSLYYAVDQAMHNIKRFLIQSSKSYLLNQM LPKTKEQLLAFDQQTLRNVNDFINKNQGVLGESLAKDLKKKVEKRLTSLPVF NLEDLPISEFEDLIHSHEIDIILNNIILNLRYKDNNLIDLSGYGAKVEVYDGVEL NDKNQFKLTSSANSKIRVTQNQNIIFNSVFLDFSVSFWIRIPKYKNDGIQNYIH NEYTIINCMKNNSGWKISIRGNRIIWTLIDINGKTKSVFFEYNIREDISEYINRW FFVTITNNLNNAKIYINGKLESNTDIKDIREVIANGEIIFKLDGDIDRTQFIWMK YFSIFNTELSQSNIEERYKIQSYSEYLKDFWGNPLMYNKEYYMFNAGNKNSYI KLKKDSPVGEILTRSKYNQNSKYINYRDLYIGEKFIIRRKSNSQSINDDIVRKE DYIYLDFFNLNQEWRVYTYKYFKKEEEKLFLAPISDSDEFYNTIQIKEYDEQPT YSCQLLFKKDEESTDEIGLIGIHRFYESGIVFEEYKDYFCISKWYLKEVKRKPY NLKLGCNWQFIPKDEGWTE |
| 125 | BoNT/EN-LC-$H_N$ (with modified linker containing thrombin cleavage site) and BoNT/C 1-$H_C$ | MVTINDLHYSDPIDEDNIINMRIPLYDLEVDDQFINHNVPDLKAFQVFPNVWV VPERYTFYSTMKNLDAPANPSRSSYYDPTYLQSDAEKEVFLQQMILLFKRINS TQEGQQFLNLLSRSIPVPYESNGDVAMGTTQVIKQMDDKGNVLKHRRAHIIIY GPGPDLMAKGSKALTKSRETGRGCMAEIYFSPMYHKTYSTKLTNKNSLVDK SVQEFVPDPAVTLIHELCHGLHALYGIDLGNVGSWEFNSNPNSLFSSWFSSKE AVNFEEVMTFGGEDVKVIKSEIDKKIPGILNLIKTTVEPIINKITDPHDEMLQCL QSKYPSLKGTLGQFFFDDTQLEKDIRDLWMVMNETMFAENLKALTRARYLV PKVENIVQVDILSPNVYTIDKGFNHLSKGFKGQSVSQSYFRKISALARGAVVR ACPNPHFSSQLVPRGSLSSCIEILEDDLFIMSSKDSFTDTDFSEPSVGPVSYKAK KGADTILDSTLSNYDFSKEINFTSTVPIITVEDPLETDEDVPVISEDRTVYVDDY TTFHFLEAQKIGKEVVPTQTKVVFTTNMEEALFDSKKVYTVFENTASRINEAG TGIANGMMFYQWLKGIVQDFTEEATQKDTFDKISDVTMIVPYLGNILNIGNDI RKGDFMGAVELGGVTILLEAIPELTLPVLIGLTIIEDELEKEQVSQTVYNVLDK RDEKWEEVYGFVKQQWWWMVHTQFETRILHAYQALNHQVEAIKANMTYQ LANYRGNQEDKELLEKAIDDTLQSLYYAVDQAMHNIKRFLIQSSKSYLLNQM LPKTKEQLLAFDQQTLRNVNDFINKNQGVLGESLAKDLKKKVEKRLTSLPVF NLEDLPISEFEDLIHSHEIDIINDSKILSLQNRKNTLVDTSGYNAEVSEEGDVQL NPIFPFDFKLGSSGEDRGKVIVTQNENIVYNSMYESFSISFWIRINKWVSNLPG YTIIDSVKNNSGWSIGIISNFLVFTLKQNEDSEQSINFSYDISNNAPGYNKW1Th V TVTNNMMGNMKIYINGKLIDTIKVKELTGINFSKTITFEINKIPDTGLITSDSDN INMWIRDFYIFAKELDGKDINILFNSLQYTNVVKDYWGNDLRYNKEYYMVNI DYLNRYMYANSRQIVFNTRRNNNDFNEGYKIIIKRIRGNTNDTRVRGGDILYF DMTINNKAYNLFMKNETMYADNHSTEDIYAIGLREQTKDINDNIIFQIQPMNN TYYYASQIFKSNFNGENISGICSIGTYRFRLGGDWYRHNYLVPTVKQGNYASL LESTSTHWGFVPVSE |
| 126 | BoNT/EN-LC-$H_N$ (with modified linker containing | MVTINDLHYSDPIDEDNIINMRIPLYDLEVDDQFINHNVPDLKAFQVFPNVWV VPERYTFYSTMKNLDAPANPSRSSYYDPTYLQSDAEKEVFLQQMILLFKRINS TQEGQQFLNLLSRSIPVPYESNGDVAMGTTQVIKQMDDKGNVLKHRRAHIIIY |

TABLE 1-continued

Exemplary, non-limiting BoNT amino acid sequences

| SEQ ID NO | Description | Sequence |
|---|---|---|
| | thrombin cleavage site) and BoNT/X-$H_C$ | GPGPDLMAKGSKALTKSRETGRGCMAEIYFSPMYHKTYSTKLTNKNSLVDK<br>SVQEFVPDPAVTLIHELCHGLHALYGIDLGNVGSWEFNSNPNSLFSSWFSSKE<br>AVNFEEVMTFGGEDVKVIKSEIDKKIPGILNLIKTTVEPIINKITDPHDEMLQCL<br>QSKYPSLKGTLGQFFFDDTQLEKDIRDLWMVMNETMFAENLKALTRARYLV<br>PKVENIVQVDILSPNVYTIDKGFNHLSKGFKGQSVSQSYFRKISALARGAVVR<br>ACPNPHFSSQLVPRGSLSSCIEILEDDLFIMSSKDSFTDTDFSEPSVGPVSYKAK<br>KGADTILDSTLSNYDFSKEINFTSTVPIITVEDPLETDEDVPVISEDRTVYVDDY<br>TTFHFLEAQKIGKEVVPTQTKVVFTTNMEEALFDSKKVYTVFENTASRINEAG<br>TGIANGMMFYQWLKGIVQDFTEEATQKDTFDKISDVTMIVPYLGNILNIGNDI<br>RKGDFMGAVELGGVTILLEAIPELTLPVLIGLTIIEDELEKEQVSQTVYNVLDK<br>RDEKWEEVYGFVKQQWWWMVHTQFETRILHAYQALNHQVEAIKANMTYQ<br>LANYRGNQEDKELLEKAIDDTLQSLYYAVDQAMHNIKRFLIQSSKSYLLNQM<br>LPKTKEQLLAFDQQTLRNVNDFINKNQGVLGESLAKDLKKKVEKRLTSLPVF<br>NLEDLPISEFEDLIHSHEIDIEDYEVLNLGAEDGKIKDLSGTTSDINIGSDIELAD<br>GRENKAIKIKGSENSTIKIAMNKYLRFSATDNFSISFWIKHPKPTNLLNNGIEYT<br>LVENFNQRGWKISIQDSKLIWYLRDHNNSIKIVTPDYIAFNGWNLITITNNRSK<br>GSIVYVNGSKIEEKDISSIWNTEVDDPIIFRLKNNRDTQAFTLLDQFSIYRKELN<br>QNEVVKLYNYYFNSNYIRDIWGNPLQYNKKYYLQTQDKPGKGLIREYWSSF<br>GYDYVILSDSKTITFPNNIRYGALYNGSKVLIKNSKKLDGLVRNKDFIQLEIDG<br>YNMGISADRFNEDTNYIGTTYGTTHDLTTDFEIIQRQEKYRNYCQLKTPYNIF<br>HKSGLMSTETSKPTFHDYRDWVYSSAWYFQNYENLNLRKHTKTNWYFIPKD<br>EGWDED |
| 127 | BoNT/A1 (ACS52162.1) | MPFVNKQFNYKDPVNGVDIAYIKIPNAGQMQPVKAFKIHNKIWVIPERDTFT<br>NPEEGDLNPPPEAKQVPVSYYDSTYLSTDNEKDNYLKGVTKLFERIYSTDLGR<br>MLLTSIVRGIPFWGGSTIDTELKVIDTNCINVIQPDGSYRSEELNLVIIGPSADII<br>QFECKSFGHEVLNLTRNGYGSTQYIRFSPDFTFGFEESLEVDTNPLLGAGKFA<br>TDPAVTLAHELIHAGHRLYGIAINPNRVFKVNTNAYYEMSGLEVSFEELRTFG<br>GHDAKFIDSLQENEFRLYYYNKFKDIASTLNKAKSIVGTTASLQYMKNVFKE<br>KYLLSEDTSGKFSVDKLKFDKLYKMLTEIYTEDNFVKFFKVLNRKTYLNFDK<br>AVFKINIVPKVNYTIYDGFNLRNTNLAANFNGQNTEINNMNFTKLKNFTGLFE<br>FYKLLCVRGIITSKTKSLDKGYNKALNDLCIKVNNWDLFFSPSEDNFTNDLNK<br>GEEITSDTNIEAAEENISLDLIQQYYLTFNFDNEPENISIENLSSDIIGQLELMPNI<br>ERFPNGKKYELDKYTMFHYLRAQEFEHGKSRIALTNSVNEALLNPSRVYTFFS<br>SDYVKKVNKATEAAMFLGWVEQLVYDFTDETSEVSTTDKIADITIIIPYIGPAL<br>NIGNMLYKDDFVGALIFSGAVILLEFIPEIAIPVLGTFALVSYIANKVLTVQTID<br>NALSKRNEKWDEVYKYIVTNWLAKVNTQIDLIRKKMKEALENQAEATKAII<br>NYQYNQYTEEEKNNINFNIDDLSSKLNESINKAMININKFLNQCSVSYLMNSM<br>IPYGVKRLEDFDASLKDALLKYIYDNRGTLIGQVDRLKDKVNNTLSTDIPFQL<br>SKYVDNQRLLSTFTEYIKNIINTSILNLRYESNHLIDLSRYASKINIGSKVNFDPI<br>DKNQIQLFNLESSKIEVILKNAIVYNSMYENFSTSFWIRIPKYFNSISLNNEYTII<br>NCMENNSGWKVSLNYGEIIWTLQDTQEIKQRVVFKYSQMINISDYINRWIFVT<br>ITNNRLNNSKIYINGRLIDQKPISNLGNIHASNNIMFKLDGCRDTHRYIWIKYF<br>NLFDKELNEKEIKDLYDNQSNSGILKDFWGDYLQYDKPYYMLNLYDPNKYV<br>DVNNVGIRGYMYLKGPRGSVMTTNIYLNSSLYRGTKFIIKKYASGNKDNIVR<br>NNDRVYINVVVKNKEYRLATNASQAGVEKILSALEIPDVGNLSQVVVMKSK<br>NDQGITNKCKMNLQDNNGNDIGFIGFHQFNNIAKLVASNWYNRQIERSSRTL<br>GCSWEFIPVDDGWGERPL |
| 128 | BoNT/A2 (X73423) | MPFVNKQFNYKDPVNGVDIAYIKIPNAGQMQPVKAFKIHNKIWVIPERDTFT<br>NPEEGDLNPPPEAKQVPVSYYDSTYLSTDNEKDNYLKGVTKLFERIYSTDLGR<br>MLLTSIVRGIPFWGGSTIDTELKVIDTNCINVIQPDGSYRSEELNLVIIGPSADII<br>QFECKSFGHDVLNLTRNGYGSTQYIRFSPDFTFGFEESLEVDTNPLLGAGKFA<br>TDPAVTLAHELIHAEHRLYGIAINPNRVFKVNTNAYYEMSGLEVSFEELRTFG<br>GHDAKFIDSLQENEFRLYYYNKFKDVASTLNKAKSIIGTTASLQYMKNVFKE<br>KYLLSEDTSGKFSVDKLKFDKLYKMLTEIYTEDNFVNFFKVINRKTYLNFDK<br>AVFRINIVPDENYTIKDGFNLKGANLSTNFNGQNTEINSRNFTRLKNFTGLPEF<br>YKLLCVRGIIPFKTKSLDEGYNKALNDLCIKVNNWDLFFSPSEDNFTNDLDKV<br>EEITADTNIEAAEENISLDLIQQYYLTFDFDNEPENISIENLSSDIIGQLEPMPNIE<br>RFPNGKKYELDKYTMFHYLRAQEFEHGDSRIILTNSAEEALLKPNVAYTFFSS<br>KYVKKINKAVEAFMFLNWAEELVYDFTDETNEVTTMDKIADITIIVPYIGPAL<br>NIGNMLSKGEFVEAIIFTGVVAMLEFIPEYALPVFGTFAIVSYIANKVLTVQTIN<br>NALSKRNEKWDEVYKYTVTNWLAKVNTQIDLIREKMKKALENQAEATKAII<br>NYQYNQYTEEEKNNINFNIDDLSSKLNESINSAMININKFLDQCSVSYLMNSM<br>IPYAVKRLKDFDASVRDVLLKYIYDNRGTLVLQVDRLKDEVNNTLSADIPFQ<br>LSKYVDNKKLLSTFTEYIKNIVNTSILSIVYKKDDLIDLSRYGAKINIGDRVYY<br>DSIDKNQIKLINLESSTIEVILKNAIVYNSMYENFSTSFWIKIPKYFSKINLNNEY<br>TIINCIENNSGWKVSLNYGEIIWTLQDNKQNIQRVVFKYSQMVNISDYINRWIF<br>VTITNNRLTKSKIYINGRLIDQKPISNLGNIHASNKIMFKLDGCRDPRRYIMIKY<br>FNLFDKELNEKEIKDLYDSQSNSGILKDFWGNYLQYDKPYYMLNLFDPNKYV<br>DVNNIGIRGYMYLKGPRGSVVTTNIYLNSTLYEGTKFIIKKYASGNEDNIVRN<br>NDRVYINVVVKNKEYRLATNASQAGVEKILSALEIPDVGNLSQVVVMKSKD<br>DQGIRNKCKMNLQDNNGNDIGFIGFHLYDNIAKLVASNWYNRQVGKASRTF<br>GCSWEFIPVDDGWGESSL |

TABLE 1-continued

Exemplary, non-limiting BoNT amino acid sequences

| SEQ ID NO | Description | Sequence |
|---|---|---|
| 129 | BoNT/A3 (aba29017) | MPFVNKPFNYRDPGNGVDIAYIKIPNAGQMQPVKAFKIHEGVWVIPERDTFT<br>NPEEGDLNPPPEAKQVPVSYYDSTYLSTDNEKDNYLKGVIKLFDRIYSTGLGR<br>MLLSFIVKGIPFWGGSTIDTELKVIDTNCINVIEPGGSYRSEELNLVITGPSADII<br>QFECKSFGHDVFNLTRNGYGSTQYIRFSPDFTFGFEESLEVDTNPLLGAGTFAT<br>DPAVTLAHELIHAAHRLYGIAINPNRVLKVKTNAYYEMSGLEVSFEELRTFGG<br>NDTNFIDSLWQKKFSRDAYDNLQNIARILNEAKTIVGTTTPLQYMKNIFIRKY<br>FLSEDASGKISVNKAAFKEFYRVLTRGFTELEFVNPFKVINRKTYLNFDKAVF<br>RINIVPDENYTINEGFNLEGANSNGQNTEINSRNFTRLKNFTGLFEFYKLLCVR<br>GIIPFKTKSLDEGYNKALNYLCIKVNNWDLFFSPSEDNFTNDLDKVEEITADT<br>NIEAAEENISSDLIQQYYLTFDFDNEPENISIENLSSDIIGQLEPMPNIERFPNGK<br>KYELDKYTMFHYLRAQEFEHGDSRIILTNSAEEALLKPNVAYTFFSSKYVKKI<br>NKAVEAVIFLSWAEELVYDFTDETNEVTTMDKIADITIIVPYIGPALNIGNMVS<br>KGEFVEAILFTGVVALLEFIPEYSLPVFGTFAIVSYIANKVLTVQTINNALSKRN<br>EKWDEVYKYTVTNWLAKVNTQIDLIREKMKKALENQAEATRAIINYQYNQY<br>TEEEKNNINFNIDDLSSKLNRSINRAMININKFLDQCSVSYLMNSMIPYAVKRL<br>KDFDASVRDVLLKYIYDNRGTLILQVDRLKDEVNNTLSADIPFQLSKYVNDK<br>KLLSTFTEYIKNIVNTSILSIVYKKDDLIDLSRYGAKINIGDRVYYDSIDKNQIK<br>LINLESSTIEVILKNAIVYNSMYENFSTSFWIKIPKYFSKINLNNEYTIINCIENNS<br>GWKVSLNYGEIIWTLQDNKQNIQRVVFKYSQMVNISDYINRWMFVTITNNRL<br>TKSKIYINGRLIDQKPISNLGNIHASNKIMFKLDGCRDPRRYIMIKYFNLFDKEL<br>NEKEIKDLYDSQSNPGILKDFWGNYLQYDKPYYMLNLFDPNKYVDVNNIGIR<br>GYMYLKGPRGSVMTTNIYLNSTLYMGTKFIIKKYASGNEDNIVRNNDRVYIN<br>VVVKNKEYRLATNASQAGVEKILSALEIPDVGNLSQVVVMKSKDDQGIRNK<br>CKYINLQDNNGNDIGFVGFHLYDNIAKLVASNWYNRQVGKASRTFGCSWEFI<br>PVDDGWGESSL |
| 130 | BoNT/A4 (aba29018) | MPLVNQQINYYDPVNGVDIAYIKIPNAGKMQPVKAFKIHNKVWVIPERDIFTN<br>PEEVDLNPPPEAKQVPISYYDSAYLSTDNEKDNYLKGVIKLFERIYSTDLGRM<br>LLISIVRGIPFWGGGKIDTELKVIDTNCINIIQLDDSYRSEELNLAIIGPSANIIES<br>QCSSFRDDVLNLTRNGYGSTQYIRFSPDFTVGFEESLEVDTNPLLGAGKFAQD<br>PAVALAHELIHAEHRLYGIAINTNRVFKVNTNAYYEMAGLEVSLEELITFGGN<br>DAKFIDSLQKKEFSLYYYNKFKDIASTLNKAKSIVGTTASLQYMKNVFKEKY<br>LLSEDATGKFLVDRLKFDELYKLLTEIYTEDNFVKFFKVLNRKTYLNFDKAVF<br>KINIVPDVNYTIHDGFNLRNTNLAANFNGQNIEINNKNFDKLKNFTGLFEFYK<br>LLCVRGIITSKTKSLDEGYNKALNELCIKVNNWDLFFSPSEDNFTNDLDKVEEI<br>TSDTNIEAAEENISLDLIQQYYLNFNFDNEPENTSIENLSSDIIGQLEPMPNIERF<br>PNGKKYELNKYTMFHYLRAQEFKHSNSRIILTNSAKEALLKPNIVYTFFSSKYI<br>KAINKAVEAVTFVNWIENLVYDFTDETNEVSTMDKIADITIVIPYIGPALNIGN<br>MIYKGEFVEAIIFSGAVILLEIVPEIALPVLGTFALVSYVSNKVLTVQTIDNALS<br>KRNEKWDEVYKYIVTNWLAIVNTQINLIREKMKKALENQAEATKAIINYQYN<br>QYTEEEKNNINFNIDDLSSKLNESINSAMININKFLDQCSVSYLMNSMIPYAVK<br>RLKDFDASVRDVLLKYIYDNRGTLIGQVNRLKDKVNNTLSADIPFQLSKYVD<br>NKKLLSTFTEYIKNITNASILSIVYKDDDLIDLSRYGAEIYNGDKVYYNSIDKN<br>QIRLINLESSTIEVILKKAIVYNSMYENFSTSFWIRIPKYFNSISLNNEYTIINCME<br>NNSGWKVSLNYGEIIWTFQDTQEIKQRVVFKYSQMINISDYINRWIFVTITNN<br>RITKSKIYINGRLIDQKPISNLGNIHASNKIMFKLDGCRDPHRYIVIKYFNLFDK<br>ELSEKEIKDLYDNQSNSGILKDFWGDYLQYDKSYYMLNLYDPNKYVDVNNV<br>GIRGYMYLKGPRDNVMTTNIYLNSSLYMGTKFIIKKYASGNKDNIVRNNDRV<br>YINVVVKNKEYRLATNASQAGVEKILSALEIPDVGNLSQVVVMKSKNDQGIT<br>NKCKMNLQDNNGNDIGFIGFHQFNNIAKLVASNWYNRQIERSSRTLGCSWEF<br>IPVDDGWRERPL |
| 131 | BoNT/A5 (a661222) | MPFVNKQFNYKDPVNGVDIAYIKIPNAGQMQPVKAFKIHNKIWVIPERDTFT<br>NPEEGDLNPPPEAKQVPVSYYDSTYLSTDNEKDNYLKGVTKLFERIYSTELGR<br>MLLTSIVRGIPFWGGSTIDTELKVIDTNCINVIQPDGSYRSEELNLVIIGPSADII<br>QFECKSFGHDVLNLTRNGYGSTQYIRFSPDFTFGFEESLEVDTNPLLGAGKFA<br>TDPAVTLAHELIHAGHRLYGIAINPNRVFKVNTNAYYEMSGLEVSFEELRTFG<br>EHDAKFIDSLQENEFRLYYYNKFKDIASTLNKAKSIVGTTASLQYMKNVFKE<br>KYLLSEDTSGKFSVDKLKFDKLYKMLTEIYTEDNFVKFFKVLNRKTYLNFDK<br>AVFKINIVPEVNYTIYDGFNLRNTNLAANFNGQNTEINNMNFTKLKNFTGLFE<br>FYKLLCVRGIITSKTKSLDEGYNKALNDLCIKVNNWDLFFSPSEDNFTNDLNK<br>GEEITSDTNIEAAEENISLDLIQQYYLTFNFDNEPENISIENLSSDIIGQLELMPNI<br>ERFPNGKKYELDKYTMFHYLRAQEFEHGKSRIVLTNSVNEALLNPSSVYTFFS<br>SDYVRKVNKATEAAMFLGWVEQLVYDFTDETSEVSTTDKIADITIIIPYIGPAL<br>NIGNMLYKDDFVGALIFSGAVILLEFIPEIAIPVLGTFALVSYIANKVLTVQTID<br>NALSKRNEKWGEVYKYIVTNWLAKVNTQIDLIRKKMKEALENQAEATKAII<br>NYQYNQYTEEEKNNINFNIGDLSSKLNDSINKAMININKFLNQCSVSYLMNSM<br>IPYGVKRLEDFDASLKDALLKYIYDNRGTLIGQVDRLKDKVNNTLSTDIPFQL<br>SKYVDNQRLLSTFTEYIKNIINTSILNLRYESNHLIDLSRYASEINIGSKVNFDPI<br>DKNQIQLFNLESSKIEIILKNAIVYNSMYENFSTSFWIKIPKYFSKINLNNEYTII<br>NCIENNSGWKVSLNYGEIIWTLQDNKQNIQRVVFKYSQMVAISDYINRWIFITI<br>TNNRLNNSKIYINGRLIDQKPISNLGNIHASNNIMFKLDGCRDPQRYIWIKYFN<br>LFDKELNEKEIKDLYDNQSNSGILKDFWGNYLQYDKPYYMLNLYDPNKYVD |

TABLE 1-continued

Exemplary, non-limiting BoNT amino acid sequences

| SEQ ID NO | Description | Sequence |
|---|---|---|
| | | VNNVGIRGYMYLKGPRGSIVTTNIYLNSSLYMGTKFIIKKYASGNKDNIVRNN<br>DRVYINVVVKNKEYRLATNASQAGVEKILSVLEIPDVGNLSQVVVMKSKND<br>QGIRNKCKMNLQDNNGNDIGFIGFHQFNNIDKLVASNWYNRQIERSSRTFGC<br>SWEFIPVDDGWGESPL |
| 132 | BoNT/A6 (fj981696) | MPFVNKQFNYKDPVNGVDIAYIKIPNAGQMQPVKAFKIHNKIWVIPERDTFT<br>NPEEGDLNPPPEAKQVPVSYYDSTYLSTDNEKDNYLKGVTKLFERIYSTDLGR<br>MLLTSIVRGIPFWGGSTIDTELKVIDTNCINVIQPDGSYRSEELNLVIIGPSADII<br>QFECKSFGHEVLNLTRNGYGSTQYIRFSPDFTFGFEESLEVDTNPLLGAGKFA<br>TDPAVTLAHELIHAGHRLYGIAINPNRVFKVNTNAYYEMSGLEVSFEELRTFG<br>GHDAKFIDSLQENEFRLYYYNKFKDIASTLNKAKSIVGTTASLQYMKNVFKE<br>KYLLSEDTSGKFSVDKLKFDKLYKMLTEIYTEDNFVKFFKVLNRKTYLNFDK<br>AVFKINIVPKVNYTIYDGFNLRNTNLAANFNGQNTEINNMNFAKLKNFTGLFE<br>FYKLLCVRGIITSKTKSLDKGYNKALNDLCIKVNNWDLFFSPSEDNFTNDLNK<br>GEEITSDTNIEAAEENISLDLIQQYYLTFNFDNEPENISIENLSSDIIGQLELMPNI<br>ERFPNGKKYELDKYTMFHYLSAQEFEHGKSRIDLTNSVNEALLNPSHVYTFFS<br>SDYVKKVNKATEAAMFLGWVEQLVYDFTDETSEVSTTDKIADITIIIPYIGPAL<br>NIGNMLYKDDFVGALIFSGAVILLEFIPEIAIPVLGTFAIVSYIANKVLTVQTINN<br>ALSKRNEKWDEVYKYTVTNWLAKVNTQIDLIREKMKKALENQAEATKAIIN<br>YQYNQYTEEEKNNINFNIDDLSSKLNESINSAMININKFLDQCSVSYLMNSMIP<br>YAVKRLKDFDASVRDVLLKYIYDNRGTLIGQVDRLKDKVNNTLSTDIPFQLS<br>KYVDNQRLLSTFTEYIKNIINTSILSLRYENNHLIDLSRYASKINIGSRVNFDPID<br>KNQIQLFNLESSKIEVILKNAIVYNSMYENFSTSFWIKIPKYFSEISLNNEYTIIN<br>CIENNSGWKVSLNYGEIIWTLQDNKQNIQRVVFKYSQMVAISDYINRWIFITIT<br>NNRLTKSKIYINGRLIDQKPISNLGNIHASNKIMFKLDGCRDPRRYIMIKYFNL<br>FDKELNEKEIKDLYDSQSNSGILKDFWGNYLQYDKPYYMLNLFDPNKYVDV<br>NNVGIRGYMYLKGSRSTLLTTNIYLNSGLYMGTKFIIKKYASGNKDNIVRNN<br>DRVYINVVVNNKEYRLATNASQAGVEKILSALEIPDIGNLSQVVVMKSKNDQ<br>GIRNKCKMNLQDNNGNDIGFIGFHKFNDIYKLVASNWYNRQIEISSRTFGCSW<br>EFIPVDDGWGEKPL |
| 133 | BoNT/A7 (JQ954969) | MPFVNKQFNYKDPVNGVDIAYIKIPNAGQMQPVKAFKIHNKIWVIPERDIFTN<br>PEEGDLNPPPEAKQVPVSYYDSTYLSTDNEKDNYLKGVTKLFERIYSTDLGR<br>MLLTSIVRGIPFWGGSTIDTELKVIDTNCINVIQPDGSYRSEELNLVIIGPSADII<br>NFECKSFGHDVLNLTRNGYGSTQYIRFSPDFTFGFEESLEVDTNPLLGAGKFAI<br>DPAVTLAHELIHAGHRLYGIAINPNRVFKVNTNAYYEMSGLEVSFEELRTFGG<br>HDAKFIDSLQENEFRLYYYNKFKEVASILNKAKSIIGTTASLQYMKNVFKEKY<br>LLSEDTSGKFSVDKLRFDKLYKMLTEIYTEDNFVKFFKVLNRKTYLNFDKAV<br>FKMNIVPEVNYTIYDGFNLRNTNLAANFNGQNTEINNMNFTKLKNFTGLFEF<br>YKLLCVRGIITSKTKSLDEGYNKALNDLCIKVNNWDLFFSPSEDNFTNDLNKG<br>EEITSDTNIEAAEENISSDLIQQYYLTFNFDNEPENISIENLSSDIIGQLELMPNIE<br>RFPNGKKYELDKYTMFHYLRAQEFEYGNSRIVLINSVNEALLNPSSVYTFFSS<br>DYVKKANEATEAAMFLGWVEQLVYDFTDETSEVSTMDKIADITIIVPYIGPAL<br>NIGNMVYKKKFEEALIFSGAVILLEFVPEIVLPILGTFALVSYTSNKVLTVRTID<br>NALSKRNEKWEEVYKYIVTNWLAKVNTQINLIRKKMKEALENQAEATKAIIN<br>YQYNQYTEEEKNNINFNIGDLSSKLNDSINKAMININKFLDQCSVSYLMNSMI<br>PQGVKQLKDFDTSLRDSLLKYIYDNRGTLIGQVDRLKDKVNNTLSTDIPFQLS<br>KYADNQRLLSTFTEYIKNIINTSILNLRYESNHLIDLSRYASKINIGSRVNFDPID<br>KNQIQLFNLESSKIEVILKNAIVYNSMYENFSTSFWIKIPKYFSKINLNNEYTIIN<br>CIENNSGWKVSLNYGEIIWTLQDNEQNIQRVVFKYSQMVNISDYINRWIFVTI<br>TNNRLTKSKIYINGRLIDQKPISNLGNIHASNKIMFKLDGCRDPHRYILIKYFNL<br>FDKELNEKEIKDLYDNQSNSGILKDFWGDYLQYDKPYYMLNLYDPNKYIDV<br>NNIGIRGYMYLKGPRGSVTTTNIYLNSMLYMGTKFIIKKHASGNKDNIVRNN<br>DRVYINVLVKNKEYRLATNASQAGGEKILSAVEIPDVGNLSQVVVMKSKND<br>QGIRNKCKMNLQDNNGNDIGFIGFHQFNNIAKLVASNWYNRQIGKTSVTLGC<br>SWELIPVDYGWGESSL |
| 134 | BoNT/A8 (KM233166) | MPFVNKQFNYKDTVNGIDIAYIKIPNAGQMQPVKAFKIHNKIWVIPERDTFTN<br>PKEGDLNPPPEAKQVPVSYYDSTYLSTDNEKDNYLKGVTKLFERIYSTDLGR<br>MLLTSIVRGIPFWGGSTIDTELKVIDTNCINVIQPDGSYRSEELNLVIIGPSADII<br>QFECKSFGHDVLNLTRNGYGSTQYIRFSPDFTFGFEESLEVDTNPLLGAGKFA<br>TDPAVTLAHELIHAEHRLYGIAINPNRVFKVNTNAYYEMSGLEVSFEELRTFG<br>GHNAKFIDSLQENEFRLYYYNKFKDIASTLNKAKSIVGTTASLQYMKNVFKE<br>KYLLSEDTSGKFSVDKLKFDKLYKMLTEIYTEDNFVKFFKVLNRKTYLNFDK<br>AVFKINIVPDENYTIKDGFNLKNTNLAANFNGQNTEINSRNFTKLKNFTGLFEF<br>YKLLCVRGIIPFKTKSLDEGYNKALNDLCIKVNNWDLFFSPSEDNFTNDLDKV<br>EEITSDTNIEAAEENISLDLIQQYYLTFDFDNEPENISIENLSSDIIGQLEPMPNIE<br>RFPNGKKYELDKYTMFHYLRAQEFEHSKSRIALTNSVNEALLNPSRVYTFFSS<br>DYVKKVNKATEAAMFLGWVEQLVYDFTDETSEVSTTDKIADITIIIPYIGPAL<br>NIGNMLYKDDFVGALIFSGAVILLEFIPEIAIPVLGTFALVSYIANKVLTVQTID<br>NALSKRNEKWDEVYKYIVTNWLAKVNTQIDLVRKKMKEALENQAEATKAII<br>NYQYNQYTEEEKNNINFNIDDLSSKLNESINSAMTNINKFLDQCSVSYLMNSM<br>IPYAVKRLKDFDASVREVLLKYIYDNRGTLILQVDRLKDKVNNTLSADIPFQL<br>SKYVDNKKLLSTFTEYIKNITNTSILSIVVDKDGRLIDLSRYGAEIYNGDKVSY |

TABLE 1-continued

Exemplary, non-limiting BoNT amino acid sequences

| SEQ ID NO | Description | Sequence |
|---|---|---|
| | | NSIDKNQIKLINLESSAIEVILKNAIVYNSMYENFSTSFWIKIPKYFSKINLNNEY<br>TIINCIENNSGWKVSLNYGEIIWTLQDNQQNIQRVVFKYSQMVNISDYINRWIF<br>VTITNNRLDKSKIYINGRLIDQKPISNLGNIHASNNIMFKLDGCRDPRRYIVIKY<br>FNLFDKELNEKEIKDLYDNQSNSGILKDFWGDYLQYDKPYYMLNLYDPNKY<br>VDVNNIGIRGYMYLKGPRGSVVTTNIYLNSTLYMGTKFIIKKYASGNKDNIVR<br>NNDRVYINVVVKNKEYRLATNALQAGVEKILSALEIPDVGNLSQVVVMKSK<br>NDQGIRNKCKMNLQDNNGNDIGLIGFHQFNNIAKLVASNWYNRQVGKASRT<br>FGCSWEFIPVDDGWGESSQ |
| 135 | BoNT/C (ay251553) | MPITINNFNYSDPVDNKNILYLDTHLNTLANEPEKAFRITGNIWVIPDRFSRNS<br>NPNLNKPPRVTSPKSGYYDPNYLSTDSDKDPFLKEIIKLFKRINSREIGEELIYR<br>LSTDIPFPGNNNTPINTFDFDVDFNSVDVKTRQGNNWVKTGSINPSVIITGPRE<br>NIIDPETSTFKLTNNTFAAQEGFGALSIISISPRFMLTYSNATNDVGEGRFSKSE<br>FCMDPILILMHELNHAMHNLYGIAIPNDQTISSVTSNIFYSQYNVKLEYAEIYA<br>FGGPTIDLIPKSARKYFEEKALDYYRSIAKRLNSITTANPSSFNKYIGEYKQKLI<br>RKYRFVVESSGEVTVNRNKFVELYNELTQIFTEFNYAKIYNVQNRKIYLSNVY<br>TPVTANILDDNVYDIQNGFNIPKSNLNVLFMGQNLSRNPALRKVNPENMLYL<br>FTKFCHKAIDGRSLYNKTLDCRELLVKNTDLPFIGDISDVKTDIFLRKDINEET<br>EVIYYPDNVSVDQVILSKNTSEHGQLDLLYPSIDSESEILPGENQVFYDNRTQN<br>VDYLNSYYYLESQKLSDNVEDFTFTRSIEEALDNSAKVYTYFPTLANKVNAG<br>VQGGLFLMWANDVVEDFTTNILRKDTLDKISDVSAIIPYIGPALNISNSVRRGN<br>FTEAFAVTGVTILLEAFPEFTIPALGAFVIYSKVQERNEIIKTIDNCLEQRIKRW<br>KDSYEWMMGTWLSRIITQFNNISYQMYDSLNYQAGAIKAKIDLEYKKYSGSD<br>KENIKSQVENLKNSLDVKISEAMNNINKFIRECSVTYLFKNMLPKVIDELNEF<br>DRNTKAKLINLIDSHNIILVGEVDKLKAKVNNSFQNTIPFNIFSYTNNSLLKDII<br>NEYFNNINDSKILSLQNRKNTLVDTSGYNAEVSEEGDVQLNPIFPFDFKLGSSG<br>EDRGKVIVTQNENIVYNSMYESFSISFWIRINKWVSNLPGYTIIDSVKNNSGWS<br>IGIISNFLVFTLKQNEDSEQSINFSYDISNNAPGYNKWFFVTVTNNMMGNMKI<br>YINGKLIDTIKVKELTGINFSKTITFEINKIPDTGLITSDSDNINMWIRDFYIFAKE<br>LDGKDINILFNSLQYTNVVKDYWGNDLRYNKEYYMVNIDYLNRYMYANSR<br>QIVFNTRRNNNDFNEGYKIIIKRIRGNTNDTRVRGGDILYFDMTINNKAYNLF<br>MKNETMYADNHSTEDIYAIGLREQTKDINDNIIFQIQPMNNTYYYASQIFKSN<br>FNGENISGICSIGTYRFRLGGDWYRHNYLVPTVKQGNYASLLESTSTHWGFVP<br>VSEBoNT/DMTWPVKDFNYSDPVNDNDILYLRIPQNKLITTPVKAFMITQNIW<br>VIPERFSSDTNPSLSKPPRPTSKYQSYYDPSYLSTDEQKDTFLKGIIKLFKRINE<br>RDIGKKLINYLVVGSPFMGDSSTPEDTFDFTRHTTNIAVEKFENGSWKVTNIIT<br>PSVLIFGPLPNILDYTASLTLQGQQSNPSFEGFGTLSILKVAPEFLLTFSDVTSN<br>QSSAVLGKSIFCMDPVIALMHELTHSLHQLYGINIPSDKRIRPQVSEGFFSQDG<br>PNVQFEELYTFGGLDVEIIPQIERSQLREKALGHYKDIAKRLNNINKTIPSSWIS<br>NIDKYKKIFSEKYNFDKDNTGNFVVNIDKFNSLYSDLTNVMSEVVYSSQYNV<br>KNRTHYFSRHYLPVFANILDDNIYTIRDGFNLTNKGFNIENSGQNIERNPALQK<br>LSSESVVDLFTKVCLRLTKNSRDDSTCIKVKNNRLPYVADKDSISQEIFENKIIT<br>DETNVQNYSDKFSLDESILDGQVPINPEIVDPLLPNVNMEPLNLPGEEIVFYDD<br>ITKYVDYLNSYYYLESQKLSNNVENITLTTSVEEALGYSNKIYTFLPSLAEKV<br>NKGVQAGLFLNWANEVVEDFTTNIMKKDTLDKISDVSVIIPYIGPALNIGNSA<br>LRGNFNQAFATAGVAFLLEGFPEFTIPALGVFTFYSSIQEREKIIKTIENCLEQR<br>VKRWKDSYQWMVSNWLSRITTQFNHINYQMYDSLSYQADAIKAKIDLEYKK<br>YSGSDKENIKSQVENLKNSLDVKISEAMNNINKFIRECSVTYLFKNMLPKVID<br>ELNKFDLRTKTELINLIDSHNIILVGEVDRLKAKVNESFENTMPFNIFSYTNNSL<br>LKDIINEYFNSINDSKILSLQNKKNALVDTSGYNAEVRVGDNVQLNTIYTNDF<br>KLSSSGDKIIVNLNNNILYSAIYENSSVSFWIKISKDLTNSHNEYTIINSIEQNSG<br>WKLCIRNGNIEWILQDVNRKYKSLIFDYSESLSHTGYTNKWFFVTITNNIMGY<br>MKLYINGELKQSQKIEDLDEVKLDKTIVFGIDENIDENQMLWIRDFNIFSKELS<br>NEDINIVYEGQILRNVIKDYWGNPLKFDTEYYIINDNYIDRYIAPESNVLVLVQ<br>YPDRSKLYTGNPITIKSVSDKNPYSRILNGDNIILHMLYNSRKYMIIRDTDTIYA<br>TQGGECSQNCVYALKLQSNLGNYGIGIFSIKNIVSKNKYCSQIFSSFRENTMLL<br>ADIYKPWRFSFKNAYTPVAVTNYETKLLSTSSFWKFISRDPGWVE |
| 136 | BoNT/E (x62683) | MPKINSFNYNDPVNDRTILYIKPGGCQEFYKSFNIMKNIWIIPERNVIGTTPQDF<br>HPPTSLKNGDSSYYDPNYLQSDEEKDRFLKIVTKIFNRINNNLSGGILLEELSK<br>ANPYLGNDNTPDNQFHIGDASAVEIKFSNGSQDILLPNVIIMGAEPDLFETNSS<br>NISLRNNYMPSNHGFGSIAIVTFSPEYSFRFNDNSMNEFIQDPALTLMHELIHSL<br>HGLYGAKGITTKYTITQKQNPLITNIRGTNIEEFLTFGGTDLNIITSAQSNDIYT<br>NLLADYKKIASKLSKVQVSNPLLNPYKDVFEAKYGLDKDASGIYSVNINKFN<br>DIFKKLYSFTEFDLATKFQVKCRQTYIGQYKYFKLSNLLNDSIYNISEGYNINN<br>LKVNFRGQNANLNPRIITPITGRGLVKKIIRFCKNIVSVKGIRKSICIEINNGELF<br>FVASENSYNDDNINTPKEIDDTVTSNNNYENDLDQVILNFNSESAPGLSDEKL<br>NLTIQNDAYIPKYDSNGTSDIEQHDVNELNVFFYLDAQKVPEGENNVNLTSSI<br>DTALLEQPKIYTFFSSEFINNVNKPVQAALFVSWIQQVLVDFTTEANQKSTVD<br>KIADISIVVPYIGLALNIGNEAQKGNFKDALELLGAGILLEFEPELLIPTILVFTI<br>KSFLGSSDNKNKVIKAINNALKERDEKWKEVYSFIVSNWMTKINTQFNKRKE<br>QMYQALQNQVNAIKTIIESKYNSYTLEEKNELTNKYDIKQIENELNQKVSIAM<br>NNIDRFLTESSISYLMKLINEVKINKLREYDENVKTYLLNYIIQHGSILGESQQE<br>LNSMVTDTLNNSIPFKLSSYTDDKILISYFNKFFKRIKSSSVLNMRYKNDKYV |

TABLE 1-continued

Exemplary, non-limiting BoNT amino acid sequences

| SEQ ID NO | Description | Sequence |
|---|---|---|
| | | DTSGYDSNININGDVYKYPTNKNQFGIYNDKLSEVNISQNDYIIYDNKYKNFSI SFWVRIPNYDNKIVNVNNEYTIINCMRDNNSGWKVSLNHNEIIWTLQDNAGI NQKLAFNYGNANGISDYINKWIFVTITNDRLGDSKLYINGNLIDQKSILNLGNI HVSDNILFKIVNCSYTRYIGIRYFNIFDKELDETEIQTLYSNEPNTNILKDFWGN YLLYDKEYYLLNVLKPNNFIDRRKDSTLSINNIRSTILLANRLYSGIKVKIQRV NNSSTNDNLVRKNDQVYINFVASKTHLFPLYADTATTNKEKTIKISSSGNRFN QVVVMNSVGNNCTMNFKNNNGNNIGLLGFKADTVVASTWYYTHMRDHTN SNGCFWNFISEEHGWQEK |
| 137 | BoNT/F | MPVVINSFNYNDPVNDDTILYMQIPYEEKSKKYYKAFEIMRNVWIIPERNTIG TDPSDFDPPASLENGSSAYYDPNYLTTDAEKDRYLKTTIKLFKRINSNPAGEV LLQEISYAKPYLGNEHTPINEFHPVTRTTSVNIKSSTNVKSSIILNLLVLGAGPDI FENSSYPVRKLMDSGGVYDPSNDGFGSINIVTFSPEYEYTFNDISGGYNSSTES FIADPAISLAHELIHALHGLYGARGVTYKETIKVKQAPLMIAEKPIRLEEFLTF GGQDLNIITSAMKEKIYNNLLANYEKIATRLSRVNSAPPEYDINEYKDYFQWK YGLDKNADGSYTVNENKFNEIYKKLYSFTEIDLANKFKVKCRNTYFIKYGFL KVPNLLDDDIYTVSEGFNIGNLAVNNRGQNIKLNPKIIDSIPDKGLVEKIVKFC KSVIPRKGTKAPPRLCIRVNNRELFFVASESSYNENDINTPKEIDDTTNLNNNY RNNLDEVILDYNSETIPQISNQTLNTLVQDDSYVPRYDSNGTSEIEEHNVVDL NVFFYLHAQKVPEGETNISLTSSIDTALSEESQVYTFFSSEFINTINKPVHAALFI SWINQVIRDFTTEATQKSTFDKIADISLVVPYVGLALNIGNEVQKENFKEAFEL LGAGILLEFVPELLIPTILVFTIKSFIGSSENKNKIIKAINNSLMERETKWKEIYS WIVSNWLTRINTQFNKRKEQMYQALQNQVDAIKTVIEYKYNNYTSDERNRL ESEYNINNIREELNKKVSLAMENIERFITESSIFYLMKLINEAKVSKLREYDEG VKEYLLDYISEHRSILGNSVQELNDLVTSTLNNSIPFELSSYTNDKILILYFNKL YKKIKDNSILDMRYENNKFIDISGYGSNISINGDVYIYSTNRNQFGIYSSKPSEV NIAQNNDIIYNGRYQNFSISFWVRIPKYFNKVNLNNEYTIIDCIRNNNSGWKIS LNYNKIIWTLQDTAGNNQKLVFNYTQMISISDYINKWIFVTITNNRLGNSRIYI NGNLIDEKSISNLGDIHVSDNILFKIVGCNDTRYVGIRYFKVFDTELGKTEIETL YSDEPDPSILKDFWGNYLLYNKRYYLLNLLRTDKSITQNSNFLNINQQRGVY QKPNIFSNTRLYTGVEVIIRKNGSTDISNTDNFVRKNDLAYINVVDRDVEYRL YADISIAKPEKIIKLIRTSNSNNSLGQIIVMDSIGNNCTMNFQNNNGGNIGLLGF HSNNLVASSWYYNNIRKNTSSNGCFWSFISKEHGWQEN |
| 138 | BoNT/G (x74162) | MPVNIKXFNYNDPINNDDIIMMEPFNDPGPGTYYKAFRIIDRIWIVPERFTYGF QPDQFNASTGVFSKDVYEYYDPTYLKTDAEKDKFLKTMIKLFNRINSKPSGQ RLLDMIVDAIPYLGNASTPPDKFAANVANVSINKKIIQPGAEDQIKGLMTNLII FGPGPVLSDNFTDSMIMNGHSPISEGFGARMMIRFCPSCLNVFNNVQENKDTS IFSRRAYFADPALTLMHELIHVLHGLYGIKISNLPITPNTKEFFMQHSDPVQAE ELYTFGGHDPSVISPSTDMNIYNKALQNFQDIANRLNIVSSAQGSGIDISLYKQI YKNKYDFVEDPNGKYSVDKDKFDKLYKALMFGFTETNLAGEYGIKTRYSYF SEYLPPIKTEKLLDNTIYTQNEGFNIASKNLKTEFNGQNKAVNKEAYEEISLEH LVIYRIAMCKPVMYKNTGKSEQCIIVNNEDLFFIANKDSFSKDLAKAETIAYN TQNNTIENNFSIDQLILDNDLSSGIDLPNENTEPFTNFDDIDIPVYIKQSALKKIF VDGDSLFEYLHAQTFPSNIENLQLTNSLNDALRNNNKVYTFFSTNLVEKANT VVGASLFVNWVKGVIDDFTSESTQKSTIDKVSDVSIIIPYIGPALNVGNETAKE NFKNAFEIGGAAILMEFIPELIVPIVGFFTLESYVGNKGHIIMTISNALKKRDQK WTDMYGLIVSQWLSTVNTQFYTIKERMYNALNNQSQAIEKIIEDQYNRYSEE DKMNINIDFNDIDFKLNQSINLAINNIDDFINQCSISYLMNRMIPLAVKKLKDF DDNLKRDLLEYIDTNELYLLDEVNILKSKVNRHLKDSIPFDLSLYTKDTILIQV FNNYISNISSNAILSLSYRGGRLIDSSGYGATMNVGSDVIFNDIGNGQFKLNNS ENSNITAHQSKFVVYDSMFDNFSINFWVRTPKYNNNDIQTYLQNEYTIISCIKN DSGWKVSIKGNRIIWTLIDVNAKSKSIFFEYSIKDNISDYINKWFSITITNDRLG NANIYINGSLKKSEKILNLDRINSSNDIDFKLINCTDTTKFVWIKDFNIFGRELN ATEVSSLYWIQSSTNTLKDFWGNPLRYDTQYYLFNQGMQNIYIKYFSKASMG ETAPRTNFNNAAINYQNLYLGLRFIIKKASNSRNINNDNIVREGDYIYLNIDNIS DESYRVYVLVNSKEIQTQLFLAPINDDPTFYDVLQIKKYYEKTTYNCQILCEK DTKTFGLFGIGKFVKDYGYVWDTYDNYFCISQWYLRRISENINKLRLGCNWQ FIPVDEGWTE |
| 139 | BoNT/H (F/A, WP_047402807.1) | MPVVINSFNYDDPVNDNTIIYIRPPYYETSNTYFKAFQIMDNVWIIPERYRLGI DPSLFNPPVSLKAGSDGYFDPNYLSTNTEKNKYLQIMIKLFKRINSKPAGQILL EEIKNAIPYLGNSYTQEEQFTTNNRTVSFNVKLANGNIVQQMANLIIWGPGPD LTTNKTGGIIYSPYQSMEATPYKDGFGSIMTVEFSPEYATAFNDISIASHSPSLFI KDPALILMHELIHVLHGLYGTYITEYKITPNVVQSYMKVTKPITSAEFLTFGGR DRNIVPQSIQSQLYNKVLSDYKRIASRLNKVNTATALINIDEFKNLYEWKYQF AKDSNGVYSVDLNKFEQLYKKIYSFTEFNLAYEFKIKTRLGYLAENFGPFYLP NLLDDSIYTEVDGFNIGALSINYQGQNIGSDINSIKKLQGQGVVSRVVRLCSNS NTKNSLCITVNNRDLFFIASQESYGENTINTYKEIDDTTTLDPSFEDILDKVILN FNEQVIPQMPNRNVSTDIQKDNYIPKYDYNRTDIIDSYEVGRNYNTFFYLNAQ KFSPNESNITLTSSFDTGLLEGSKVYTFFSSDFINNINKPVQALLFIEWVKQVIR DFTTEATKTSTVDKLKDISLVVPYIGLALNIGDEIYKQHFAEAVELVGAGLLL EFSPEFLIPTLLIFTIKGYLTGSIRDKDKIIKTLDNALNVRDQKWKELYRWVVS KWLTTINTQFNKRKEQMYKALKNQATAIKKIIENKYNNYTTDEKSKIDSSYNI |

TABLE 1-continued

Exemplary, non-limiting BoNT amino acid sequences

| SEQ ID NO | Description | Sequence |
|---|---|---|
| | | NEIERTLNEKINLAMKNIEQFITESSIAYLINIINNETIQKLKSYDDLVRRYLLGY IRNHSSILGNSVEELNSKVNNHLDNGIPFELSSYTNDSLLIRYFNKNYGELKYN CILNIKYEMDRDKLVDSSGYRSRINIGTGVKFSEIDKNQVQLSNLESSKIEVILN NGVIYNSMYENFSTSFWIRIPKYFRNINNEYKIISCMQNNSGWEVSLNFSNMN SKIIWTLQDTEGIKKTVVFQYTQNINISDYINRWIFVTITNNRLSNSKIYINGRLI NEESISDLGNIHASNNIMFKLDGCRDPHRYIWIKYFNLFDKELNKKEIKDLYD NQSNSGILKDFWGDYLQYDKPYYMLNLYDPNKYLDVNNVGIRGYMYLKGP RGRIVTTNIYLNSTLYMGTKFIIKKYASGNKDNIVRNNDRVYINVVVKNKEYR LATNASQAGVEKILSAVEIPDVGNLSQVVVMKSENDQGIRNKCKMNLQDNN GNDIGFIGFHQFNNIAKLVASNWYNRQIGKASRTFGCSWEFIPVDDGWGESSL |

Some of the embodiments, advantages, features, and uses of the technology disclosed herein will be more fully understood from the Examples below. The Examples are intended to illustrate some of the benefits of the present disclosure and to describe particular embodiments, but are not intended to exemplify the full scope of the disclosure and, accordingly, do not limit the scope of the disclosure.

EXAMPLES

*C. botulinum* is a gram-positive bacterium, which is evolutionary close to the model bacterium *Bacillus subtilis*, but is genetically far away from *E. coli* (FIG. 1). In this study, the possibility of expressing BoNTs in *Bacillus* is explored. There are a couple of advantages by using *Bacillus* as the expression hosts as follows: (1) *Bacillus* species are evolutionarily much closer to *C. botulinum*, the natural host of BoNTs. Therefore *Bacillus* species are likely to provide better inner environment for protein translation and coupled folding for these toxins. A known example is that TcdA/B toxins can be well expressed in *Bacillus megaterium* but not in *E. coli*. (2) *B. subtilis* is a well-studied model organism for bacteria; genetic manipulations are highly amendable in this bacterial species. Therefore, protein engineering would be feasible when using this bacterium as a host. (3) The cost of cell culture and protein purification when using *B. subtilis* is relatively low. Thus this system is very suitable for large scale protein production. (4) *B. subtilis* is known as a common gut commensal in humans and normally considered as a GRAS (general recognized as safe) organism. The Food and Drug Administration (FDA) stated that protein products from the nontoxigenic and nonpathogenic strains of *B. subtilis* are widely available and have been safely used in a variety of food applications. Products that have been successfully produced in *Bacillus* bacterium include amylase, hyaluronic acid, polyhydroxyalkanoates, and many antibiotics. Due to the unpredictability in the recombinant protein expression techniques, whether intact and active BoNTs can be produced with high yield in *Bacillus* remains to be tested.

Results

Figure 2A:
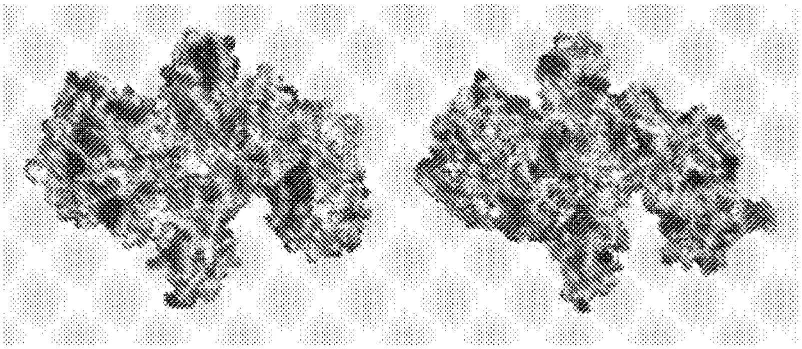
FIGS. 2A to 2B.
Figure 2B:
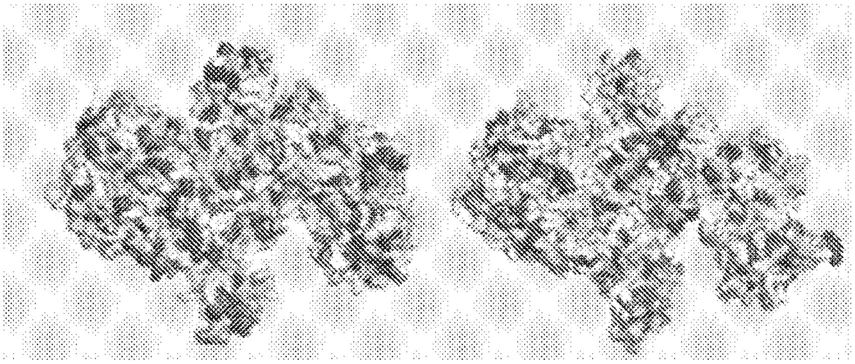
Figure 3:
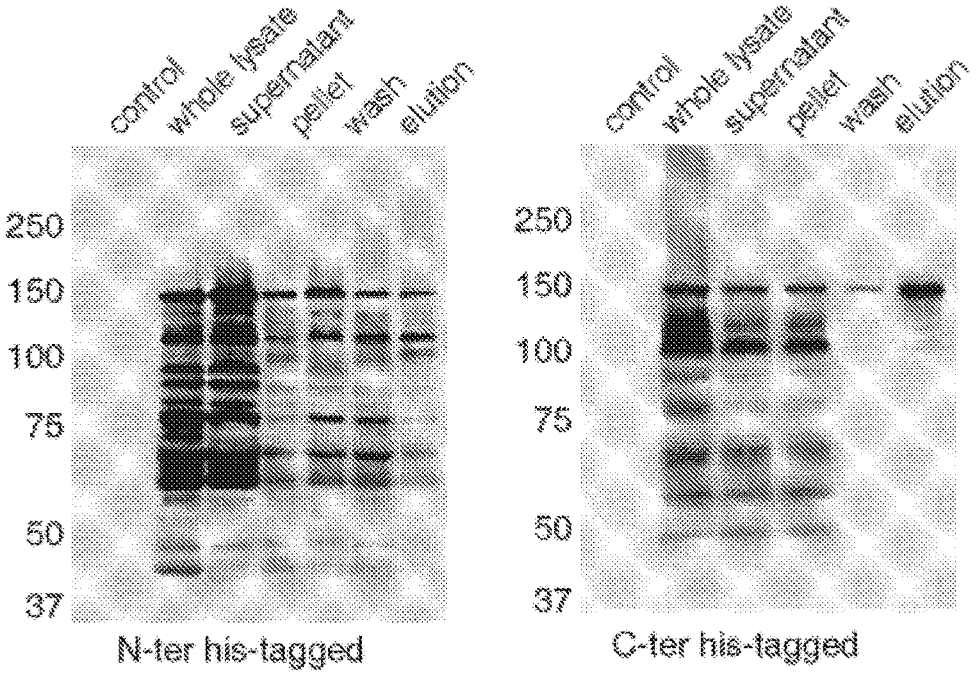
FIG. 3. Western-blots showing the expression pattern of iBoNT/B in *E. coli*. An anti-BoNT/B polyclonal antibody was used for the detection.

The crystal structure of full-length BoNT/A, BoNT/B and BoNT/E have been solved previously, giving an overall view of these molecules. Not many disulfide bonds were found within these 150-kd molecules, suggesting an oxidative environment or additional oxidative cofactors are not essential for the production of BoNTs; which is expected, because *C. botulinum* is an anaerobic bacterium. The surface distribution of the hydrophobic and hydrophilic residues are relatively even across these toxins like BoNT/A and BoNT/B (FIGS. 2A to 2B).

iBONT/B ("i" refers to the inactive form, which contains R370A/Y373F mutations at its enzymatic domain) was used as an example of BoNTs and the express pattern of it in *E. coli* was analyzed. Generally, very few products were obtained using *E. coli*, despite varying the expression conditions including growth temperature, inducer concentration, and culture medium. Therefore, the low yield of iBoNT/B in *E. coli* could be mainly because of the intrinsic defect of the host. To validate this, iBoNT/B fused with either N-terminal or C-terminal His-tag was expressed in *E. coli*. A large amount of the iBoNT/B products in the cell lysate were presented as shorter fragments wherever the tag was attached. For C-terminal tagged iBoNT/B, purification by Ni-NTA beads removed the majority of the shorter fragments. In contrast, all fragments of N-terminal tagged iBoNT/B remained after IMAC purification (FIG. 3). These results indicate the low yield of iBoNT/B in *E. coli* was mainly caused by unexpected early terminations during the translation.

Figure 4A:
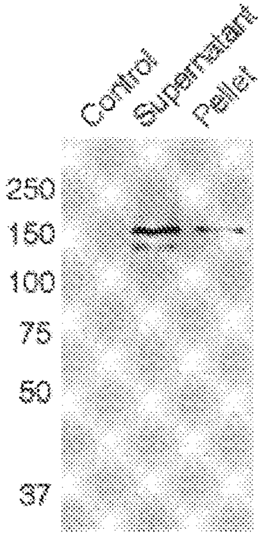
FIGS. 4A to 4B.
Figure 4B:
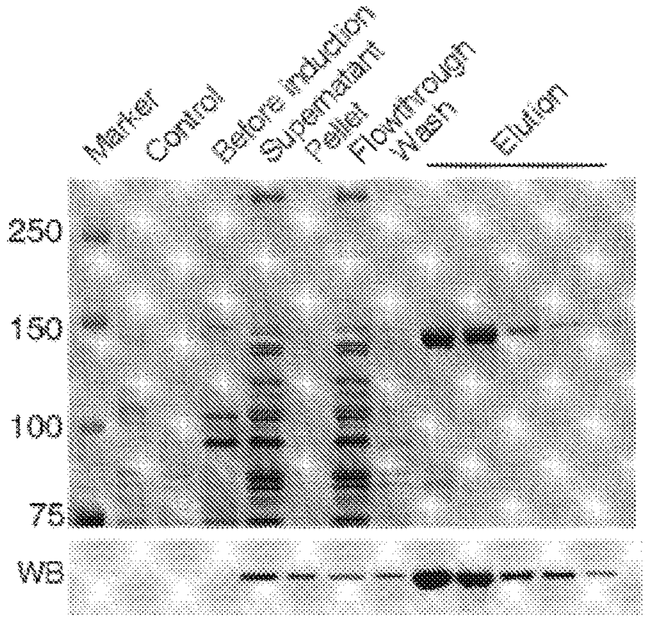

Next, the expression pattern of iBoNT/B was analyzed in *B. subtilis* by Western-blot. Unlike in *E. coli*, the majority of the expressed iBoNT/B existed as integrate full-length protein (FIGS. 4A to 4B). As a rough estimation, ~5-10 mg protein can be obtained from one litter LB cultured *B. subtilis*; while usually the yield is <0.5 mg/L culture when expressed in *E. coli*. The same phenotype was also obtained when the expression of a chimeric iBoNT/AB was tested, which contains an iBoNT/A catalytic domain, a BoNT/A translocation domain, and a BoNT/B binding domain, in *E. coli* or *B. subtilis* (data not shown). These results demonstrate that *B. subtilis* is overall a better expression host for BoNTs expression.

Figure 5:
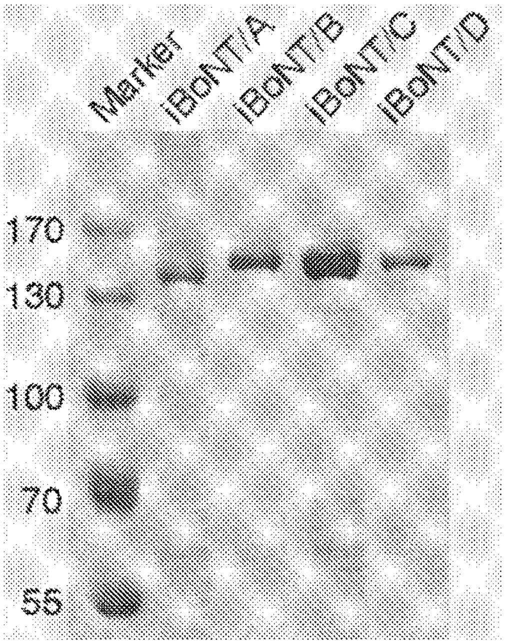
FIG. 5. Purified iBoNT/A, iBONT/B, iBONT/C, and iBoNT/D from *B. subtilis* are shown with a SDS-PAGE.

Next, the expression plasmids for other botulinum neurotoxins including iBoNT/A, iBONT/C. iBoNT/D were created, and the expression of those proteins were tested in *B. subtilis*. As expected, all of these proteins were able to be produced in *B. subtilis* with decent yields (FIG. 5).

Summary

Here, a new protocol has been developed to express full-length BoNTs in *B. subtilis* with improved protein quality and yield. This protocol could be used to produce full-length BoNTs and their variants for scientific study, to produce active toxins for medical therapy or cosmetics, and to develop natural/recombinant toxoids vaccines.

EQUIVALENTS AND SCOPE

Those skilled in the art will recognize, or be able to ascertain using no more than routine experimentation, many equivalents of the embodiments described herein. The scope of the present disclosure is not intended to be limited to the above description, but rather is as set forth in the appended claims.

Articles such as "a," "an," and "the" may mean one or more than one unless indicated to the contrary or otherwise evident from the context. Claims or descriptions that include "or" between two or more members of a group are considered satisfied if one, more than one, or all of the group members are present, unless indicated to the contrary or otherwise evident from the context. The disclosure of a group that includes "or" between two or more group members provides embodiments in which exactly one member of the group is present, embodiments in which more than one members of the group are present, and embodiments in which all of the group members are present. For purposes of brevity those embodiments have not been individually spelled out herein, but it will be understood that each of these embodiments is provided herein and may be specifically claimed or disclaimed.

It is to be understood that the disclosure encompasses all variations, combinations, and permutations in which one or more limitation, element, clause, or descriptive term, from one or more of the claims or from one or more relevant portion of the description, is introduced into another claim. For example, a claim that is dependent on another claim can be modified to include one or more of the limitations found in any other claim that is dependent on the same base claim. Furthermore, where the claims recite a composition, it is to be understood that methods of making or using the composition according to any of the methods of making or using disclosed herein or according to methods known in the art, if any, are included, unless otherwise indicated or unless it would be evident to one of ordinary skill in the art that a contradiction or inconsistency would arise.

Where elements are presented as lists, e.g., in Markush group format, it is to be understood that every possible subgroup of the elements is also disclosed, and that any element or subgroup of elements can be removed from the group. It is also noted that the term "comprising" is intended to be open and permits the inclusion of additional elements or steps. It should be understood that, in general, where an embodiment, product, or method is referred to as comprising particular elements, features, or steps, embodiments, products, or methods that consist, or consist essentially of, such elements, features, or steps, are provided as well. For purposes of brevity those embodiments have not been individually spelled out herein, but it will be understood that each of these embodiments is provided herein and may be specifically claimed or disclaimed.

Where ranges are given, endpoints are included. Furthermore, it is to be understood that unless otherwise indicated or otherwise evident from the context and/or the understanding of one of ordinary skill in the art, values that are expressed as ranges can assume any specific value within the stated ranges in some embodiments, to the tenth of the unit of the lower limit of the range, unless the context clearly dictates otherwise. For purposes of brevity, the values in each range have not been individually spelled out herein, but it will be understood that each of these values is provided herein and may be specifically claimed or disclaimed. It is also to be understood that unless otherwise indicated or otherwise evident from the context and/or the understanding of one of ordinary skill in the art, values expressed as ranges can assume any subrange within the given range, wherein the endpoints of the subrange are expressed to the same degree of accuracy as the tenth of the unit of the lower limit of the range.

Where websites are provided, URL addresses are provided as non-browser-executable codes, with periods of the respective web address in parentheses. The actual web addresses do not contain the parentheses.

In addition, it is to be understood that any particular embodiment of the present disclosure may be explicitly excluded from any one or more of the claims. Where ranges are given, any value within the range may explicitly be excluded from any one or more of the claims. Any embodiment, element, feature, application, or aspect of the compositions and/or methods of the disclosure, can be excluded from any one or more claims. For purposes of brevity, all of the embodiments in which one or more elements, features, purposes, or aspects is excluded are not set forth explicitly herein.

SEQUENCE LISTING (140 sequences)

SEQ ID NO: 1 - protein, 1291 aa, Clostridium botulinum
MPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCKSVKAPGICIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNSEILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEEKLFLAPISDSDEFYNTIQIKEYDEQPTYSCQLLFKKDEESTDEIGLIGIHRFYESGIVFEEYKDYFCISKWYLKEVKRKPYNLKLGCNWQFIPKDEGWTE

SEQ ID NO: 2 - protein, 1291 aa, Clostridium botulinum
MPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKNMEKEYRGQNKAINKQAYEEISKEHLAVYKIQMCKSVRAPGICIDVDNEDLFFIADKNSFSDDLSKNERIEYDTQSNYIENRSSIDELILDTNLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVDDFVIEANKSSTMDKIADISLIVPYIGLALNVGNETAKGNFENAFEIAGASILLEFIPELLIPVVGAFLLESYIDNKNKIIKTIDNALTKRDEKWIDMYGLIVAQWLSTVNTQFYTIKEGMYKALNYQAQALEEIIKYKYNIYSEKEKSNINIDFNDINSKLNEGINQAVDNINNFINECSVSYLMKKMIPLAVEKLLDFDNTLKKNLLNYIDENKLYLIGSAEYEKSKVDKHLKTIIPFDLSMYTNNTILIEIFNKYNSEILNNIILNLRYRDNNLIDLSGYGANVEVYDGVELNDKNQFKLTSSTNSEIRVTQNQNIIFNSMFLDFSVSFWIRIPKYKNDGIQNYIHNEYTIINCIKNNSGWKISIRGNRIIWTLTDINGKTKSVFFEYSIREDISDYINRWFFVTITNNSDNAKIYINGKLESNIDIKDIGEVIANGEIIFKLDGDIDRTQFIWMKYFSIFNTELSQSNIKEIYKIQSYSEYLKDFWGNPLMYNKEYYMFNAGNKNSYIKLKKDSSVGEILTRSKYNQNSNYINYRNLYIGEKFIIRRKSNSQSINDDIVRKEDYIYLDFFNSNREWRVYAYKDFKEEEKKLFLANIYDSNEFYKTIQIKEYDEQPTYSCQLLFKKDEESTDEIGLIGIHRFYESGIVLKDYKNYFCISKWYLKEVKRKPYNPNLGCNWQFIPKDEGWIE

SEQ ID NO: 3 - protein, 1291 aa, Clostridium botulinum
MPVTINNFNYNDPIDNDNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPRIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKNMEKEYRGQNKAINKQAYEEISKEHLAVYKIQMCKSVRAPGICIDVDNEDLFFIADKNSFSDDLSKNERIEYDTQSNYIENRSSIDELILDTNLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVDDFVIEANKSSTMDKIADISLIVPYIGLALNVGNETAKGNFENAFEIAGASILLEFIPELLIPVVGAFLLESYIDNKNKIIKTIDNALTKRDEKWIDMYGLIVAQWLSTVNTQFYTIKEGMYKALNYQAQALEEIIKYKYNIYSEKEKSNINIDFNDINSKLNEGINQAIDNINNFINECSVSYLMKKMIPLAVEKLLDFDNTLKKNLLNYIDENKLYLIGSAEYEKSKVDKHLKTIIPFDLSMYTNNTILIEIFNKYNSEILNNIILNLRYRDNNLIDLSGYGAKVEVYNGVELNDKNQFKLTSSANSKIRVTQNQDIIFNSMFLDFSVSFWIRIPKYKNDGIQNYIHNEYTIINCIKNNSGWKISIRGNKIIWTLTDINGKTKSVFFEYSIRKDVSEYINRWFFVTITNNSDNAKIYINGKLESNIDIKDIGEVIANGEIIFKLDGDIDRTQFIWMKYFSIFNTELSQSNIKEIYKIQSYSEYLKDFWGNPLMYNKEYYMFNAGNKNSYIKLKKDSSVGEILTRSKYNQNSNYINYRNLYIGEKFIIRRKSNSQSINDDIVRKEDYIYLDFFNLNQEWRVYAYKDFKKKEEKLFLANIYDSNEFYNTIQIKEYDEQPTYSCQLLFKKDEESTDEIGLIGIHRFYESGIVFKDYKDYFCISKWYLKEVKRKPYNPNLGCNWQFIPKDEGWIE

SEQ ID NO: 4 - protein, 1291 aa, Clostridium botulinum
MPVTINNFNYNDPIDNDNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVEQKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDTIQAEELYTFGGQDPSIISPSTDKSIYDKVLQNFRGIVDRLNKVLVCISDPNININIYKNKFKDKYKFVEDSEGKYSIDVESFNKLYKSLMFGFTEINIAENYKIKTRASYFSDSLPPVKIKNLLDNEIYTIEEGFNISDKNMGKEYRGQNKAINKQAYEEISKEHLAVYKIQMCKSVKVPGICIDVDNENLFFIADKNSFSDDLSKNERVEYNTQNNYIGNDFPINELILDTDLISKIELPSENTESLTDFNVDVPVYEKQPAIKKVFTDENTIFQYLYSQTFPLNIRDISLTSSFDDALLVSSKVYSFFSMDYIKTANKVVEAGLFAGWVKQIVDDFVIEANKSSTMDKIADISLIVPYIGLALNVGDETAKGNFESAFEIAGSSILLEFIPELLIPVVGVFLLESYIDNKNKIIKTIDNALTKRVEKWIDMYGLIVAQWLSTVNTQFYTIKEGMYKALNYQAQALEEIIKYKYNIYSEEEKSNININFNDINSKLNDGINQAMDNINDFINECSVSYLMKKMIPLAVKKLLDFDNTLKKNLLNYIDENKLYLIGSVEDEKSKVDKYLKTIIPFDLSTYTNNEILIKIFNKYNSEILNNIILNLRYRDNNLIDLSGYGAKVEVYDGVKLNDKNQFKLTSSADSKIRVTQNQNIIFNSMFLDFSVSFWIRIPKYRNDDIQNYIHNEYTIINCMKNNSGWKISIRGNRIIWTLIDINGKTKSVFFEYNIREDISEYINRWFFVTITNNLDNAKIYINGTLESNMDIKDIGEVIVNGEITFKLDGDVDRTQFIWMKYFSIFNTQLNQSNIKEIYKIQSYSEYLKDFWGNPLMYNKEYYMFNAGNKNSYIKLVKDSSVGEILIRSKYNQNSNYINYRNLYIGEKFIIRRKSNSQSINDDIVRKEDYIHLDFVNSNEEWRVYAYKNFKEQEQKLFLSIIYDSNEFYKTIQIKEYDEQPTYSCQLLFKKDEESTDDIGLIGIHRFYESGVLRKKYKDYFCISKWYLKEVKRKPYKSNLGCNWQFIPKDEGWTE

SEQ ID NO: 5 - protein, 1291 aa, Clostridium botulinum
MPVTINNFNYNDPIDNNNIIMMEPPFARGMGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVNDLPIVPNEKKFFMQSTDAIQAEELYTFGGQDPSIISPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKNMEKEYRGQNKAINKQAYEEISKEHLAVYKIQMCKSVKAPGICIDVDNEDLFFIADKNSFSDDLSKNERIAYNTQNNYIENDFSINELILDTDLISKIELPSENTESLTDFNVYVPVYKKQPAIKKIFTDENTIFQYLYSQTFPLDIRDISLTSSFDDALLFSNKVYSFFSMDYIKTANKVVEAGLFAGWVKQIVDDFVIEANKSSTMDKIADISLIVPYIGLALNVGNETAKGNFENAFEIAGASILLEFIPELLIPVVGAFLLESYIDNKNKIIETINSALTKRDEKWIDMYGLIVAQWLSTVNTQFYTIKEGMYKALNYQAQALEEIIKYKYNIYSEKERSNINIDFNDVNSKLNEGINQAIDNINNFINECSVSYLMKKMIPLAVEKLLDFDNTLRKNLLNYIDENKLYLIGSAEYEKSKVDKYLKTSIPFDLSTYTNNTILIEIFNKYNSDILNNIILNLRYRDNKLIDLSGYGAKVEVYDGVKLNDKNQFKLTSSANSKIRVIQNQNIIFNSMFLDFSVSFWIRIPKYKNDGIQNYIHNEYTIINCMKNNSGWKISIRGNMIIWTLIDINGKIKSVFFEYSIKEDISEYINRWFFVTITNNSDNAKIYINGKLESHIDIRDIREVIANDEIIFKLDGNIDRTQFIWMKYFSIFNTELSQSNIEEIYKIQSYSEYLKDFWGNPLMYNKEYYMFNAGNKNSYIKLKKDSSVGEILTRSKYNQNSKYINYRDLYIGEKFIIRRKSNSQSINDDIVRKEDYIYLDFFNLNQEWRVYMYKYFKKEEEKLFLAPISDSDEFYNTIQIKEYDEQPTYSCQLLFKKDEESTDEIGLIGIHRFYESGIVFKEYKDYFCISKWYLKEVKRKPYNSKLGCNWQFIPKDEGWTE

SEQ ID NO: 6 - protein, 1291 aa, Clostridium botulinum
MPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKNMEKEYRGQNKAINKQAYEEISKEHLAVYKIQMCKSVRAPGICIDVDNEDLFFIADKNSFSDDLSKNERIEYDTQSNYIENRSSIDELILDTNLISKIELPSENTESLTDFNVDVPVYEKQPAIKKFFTDENTIFQYLYSQTFPLDIRDISLTSSFDDALLFSNKVYSFFSMDYIKTANKVVEAGLFAGWVKQIVDDFVIEANKSNTMDKLADISLIVPYIGLALNVGNETAKGNFENAFEIAGASILLEFIPELLIPVVGAFLLESYIDNKNKIIKTIDNALTKRDEKWRDMYGLIVAQWLSTVNTQFYTIKEGMYKALNYQAQALEEIIKYKYNIYSEKEKSNINIDFNDINSKLNEGINQAIDNINNFINECSVSYLMKKMIPLAVEKLLDFDNTLKKNLLNYIDENKLYLIGSAEYEKSKVDKHLKTIIPFDLSMYTNNTILIEIFKKYNSEILNNIILNLRYRDNNLIDLSGYGANVEVYDGVELNDKNQFKLTSSTNSEIRVTQNQNIIFNSMFLDFSVSFWIRIPKYKNDGIQNYIHNEYTIINCIKNNSGWKISIRGNRIIWTLTDINGKTKSVFFEYSIREDISDYINRWFFVTITNNSDNAKIYINGKLESNIDIKDIGEVIANGEIIFKLDGDIDRTQFIWMKYFSIFNTELSQSNIKEIYKIQSYSEYLKDFWGNPLMYNKEYYMFNAGNKNSYIKLKKDSPVGEILTRSKYNQNSNYINYRNLYIGEKFIIRRKSNSQSINDDIVRKEDYIYLDFFNLNQEWRVYALKNFKKKEEKLFLAPISDSDEFYNTIQIKEYDEQPTYSCQLLFKKDEESTDEIGLIGIHRFYESGIVFKDYKYYFCISKWYLKEVKRKPYNPNLGCNWQFIPKDEGWIE

SEQ ID NO: 7 - protein, 1291 aa, Clostridium botulinum
MPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCKSVKAPGICIDVDNEDLFFIADKNSFSDDLSKNERIEYNTKNIYIENYFSINELILDTDLISGIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIIDDFVIEANKSSTMDKIADISLIVPYIGLALNVGNETAKGNFENAFEIAGASILLEFIPELLIPVVGAFLLESYIDNKNKIIKTIDNALTKRVEKWIDMYGLIVAQWLSTVNTQFYTIKEGMYKALNYQAQALEEIIKYKYNIYSEKEKLNINIDFNDINSKLNEGINQAIDNINNFINECSVSYLMKKMIPLAIEKLLDFDNALKKNLLNYIDENKLYLIGSVEEEKSKVDKFFKTIIPFDLSMYTNNTILIEMVNKYNSEILNNIILNLRYRDNNLIDSSGYGAKVEVYNGVELNDKNQFKLTSSANSKIKVTQNQNITFNSMFLDFSVSFWIRIPKYKNDGIQNYIHNEYTIINCMKNNSGWKISIRGNRIIWTLTDINGKTKSVFFEYSIREDISDYINRWFFVTITNNLDNAKIYINGKLESNIDIRDIREVIVNGEIIFKLDGEIDRTQFIWMKYFSIFNTELSQSNVKEIYKIQSYSKYLKDFWGNPLMYNKEYYMFNAGNKNSYIKLVKDSSVGEILTRSKYNQNSNYINYRNLYIGEKFIIRRKSSSQSISDDIVRKEDYIYLDFFNSNREWRVYAYKNFKGQEEKLFLANIYDSNEFYKTIQIKEYDEQPTYSCQLLFKKDEESTDEIGLIGIHNFYESGILFKDYKDYFCISKWYLKEVKKKPYSSNLGCNWQFIPKDEGWTE

SEQ ID NO: 8 - protein, 1292 aa, Clostridium botulinum
MPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGGEERKEGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNGKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDDEIYTIEEGFNISDKNMGKEYRGQNKAINKQAYEEISKEHLAVYKIQMCKSVRAPGICIDVDNEDLFFIADKNSFSDDLSKNERIEYNTQSNYIENDFSINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVDDFVIEANKSNTMDKIADISLIVPYIGLALNVGNETAKGNFENAFEIAGSSILLEFIPELLIPVVGAFLLESYIDNKNKIIKTIDNALTKRDEKWIDMYGLIVAQWLSTVNTQFYTIKEGMYKALNYQAQALEEIIKYKYNIYSEKEKSNISIDFNDINSKLNEGINQAIDNINDFINECSVSYLMKKMIPLAVEKLLDFDNTLKKNLLNYIDENKLYLIGSAEYEKSKVDKHLKTIMTFDLSMYTNNTILIKMVNKYNSEILNNIILNLRYRDNNLIDLSGYGANVEVYDGVELNDKNQFKLTSSTNSEIRVTQNQNIIVNSMFLDFSVSFWIRIPKYKNDGIQNYIHNEYTIINCMKNNSGWKISIRGNRIIWTLIDINGKIKSVFFEYSIRKDVSEYINRWFFVTITNNLDNAKIYINGKLESNMDIRDIREVIANGEIIFKLDGDIDRTQFIWMKYFSIFNTELSQSNIEEIYKIQSYSEYLKDFWGNPLMYNKEYYMFNAGSKNSYIKLKKDSSVGEILTRSKYNQNSQYINYRDLYIGEKFIIKRKSNSQSINDDIVRKEDYIYLDFFNLNQEWRVYAYKDFKGQKEQKLFLANIHDSNEFYKTIQIKEYDEQPTYSCQLLFKKDEESTDEIGLIGIHRFYESGFVFQEYKYYFCISKWYLKEVKKKPYNPDLGCNWQFIPKDEGWTE

SEQ ID NO: 9 - protein, 432 aa, Clostridium botulinum
ILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEEKLFLAPISDSDEFYNTIQIKEYDEQPTYSCQLLFKKDEESTDEIGLIGIHRFYESGIVFEEYKDYFCISKWYLKEVKRKPYNLKLGCNWQFIPKDEGWTE

SEQ ID NO: 10 - protein, 432 aa, Clostridium botulinum
ILNNIILNLRYRDNNLIDLSGYGANVEVYDGVELNDKNQFKLTSSTNSEIRVTQNQNIIFNSMFLDFSVSFWIRIPKYKNDGIQNYIHNEYTIINCIKNNSGWKISIRGNRIIWTLTDINGKTKSVFFEYSIREDISDYINRWFFVTITNNSDNAKIYINGKLESNIDIKDIGEVIANGEIIFKLDGDIDRTQFIWMKYFSIFNTELSQSNIKEIYKIQSYSEYLKDFWGNPLMYNKEYYMFNAGNKNSYIKLKKDSSVGEILTRSKYNQNSNYINYRNLYIGEKFIIRRKSNSQSINDDIVRKEDYIYLDFFNSNREWRVYAYKDFKEEEKKLFLANIYDSNEFYKTIQIKEYDEQPTYSCQLLFKKDEESTDEIGLIGIHRFYESGIVLKDYKNYFCISKWYLKEVKRKPYNPNLGCNWQFIPKDEGWIE

SEQ ID NO: 11 - protein, 432 aa, Clostridium botulinum
ILNNIILNLRYRDNNLIDLSGYGAKVEVYNGVELNDKNQFKLTSSANSKIRVTQNQDIIFNSMFLDFSVSFWIRIPKYKNDGIQNYIHNEYTIINCIKNNSGWKISIRGNKIIWTLTDINGKTKSVFFEYSIRKDVSEYINRWFFVTITNNSDNAKIYINGKLESNIDIKDIGEVIANGEIIFKLDGDIDRTQFIWMKYFSIFNTELSQSNIKEIYKIQSYSEYLKDFWGNPLMYNKEYYMFNAGNKNSYIKLKKDSSVGEILTRSKYNQNSNYINYRNLYIGEKFIIRRKSNSQSINDDIVRKEDYIYLDFFNLNQEWRVYAYKDFKKKEEKLFLANIYDSNEFYNTIQIKEYDEQPTYSCQLLFKKDEESTDEIGLIGIHRFYESGIVFKDYKDYFCISKWYLKEVKRKPYNPNLGCNWQFIPKDEGWIE

SEQ ID NO: 12 - protein, 432 aa, Clostridium botulinum
ILNNIILNLRYRDNNLIDLSGYGAKVEVYDGVKLNDKNQFKLTSSADSKIRVTQNQNIIFNSMFLDFSVSFWIRIPKYRNDDIQNYIHNEYTIINCMKNNSGWKISIRGNRIIWTLIDINGKTKSVFFEYNIREDISEYINRWFFVTITNNLDNAKIYINGTLESNMDIKDIGEVIVNGEITFKLDGDVDRTQFIWMKYFSIFNTQLNQSNIKEIYKIQSYSEYLKDFWGNPLMYNKEYYMFNAGNKNSYIKLVKDSSVGEILIRSKYNQNSNYINYRNLYIGEKFIIRRKSNSQSINDDIVRKEDYIHLDFVNSNEEWRVYAYKNFKEQEQKLFLSIIYDSNEFYKTIQIKEYDEQPTYSCQLLFKKDEESTDDIGLIGIHRFYESGVLRKKYKDYFCISKWYLKEVKRKPYKSNLGCNWQFIPKDEGWTE

SEQ ID NO: 13 - protein, 432 aa, Clostridium botulinum
ILNNIILNLRYRDNKLIDLSGYGAKVEVYDGVKLNDKNQFKLTSSANSKIRVIQNQNIIFNSMFLDFSVSFWIRIPKYKNDGIQNYIHNEYTIINCMKNNSGWKISIRGNMIIWTLIDINGKIKSVFFEYSIKEDISEYINRWFFVTITNNSDNAKIYINGKLESHIDIRDIREVIANDEIIFKLDGNIDRTQFIWMKYFSIFNTELSQSNIEEIYKIQSYSEYLKDFWGNPLMYNKEYYMFNAGNKNSYIKLKKDSSVGEILTRSKYNQNSKYINYRDLYIGEKFIIRRKSNSQSINDDIVRKEDYIYLDFFNLNQEWRVYMYKYFKKEEEKLFLAPISDSDEFYNTIQIKEYDEQPTYSCQLLFKKDEESTDEIGLIGIHRFYESGIVFKEYKDYFCISKWYLKEVKRKPYNSKLGCNWQFIPKDEGWTE

SEQ ID NO: 14 - protein, 432 aa, Clostridium botulinum
ILNNIILNLRYRDNNLIDLSGYGANVEVYDGVELNDKNQFKLTSSTNSEIRVTQNQNIIFNSMFLDFSVSFWIRIPKYKNDGIQNYIHNEYTIINCIKNNSGWKISIRGNRIIWTLTDINGKTKSVFFEYSIREDISDYINRWFFVTITNNSDNAKIYINGKLESNIDIKDIGEVIANGEIIFKLDGDIDRTQFIWMKYFSIFNTELSQSNIKEIYKIQSYSEYLKDFWGNPLMYNKEYYMFNAGNKNSYIKLKKDSPVGEILTRSKYNQNSNYINYRNLYIGEKFIIRRKSNSQSINDDIVRKEDYIYLDFFNLNQEWRVYALKNFKKKEEKLFLAPISDSDEFYNTIQIKEYDEQPTYSCQLLFKKDEESTDEIGLIGIHRFYESGIVFKDYKYYFCISKWYLKEVKRKPYNPNLGCNWQFIPKDEGWIE

SEQ ID NO: 15 - protein, 432 aa, Clostridium botulinum
ILNNIILNLRYRDNNLIDSSGYGAKVEVYNGVELNDKNQFKLTSSANSKIKVTQNQNITFNSMFLDFSVSFWIRIPKYKNDGIQNYIHNEYTIINCMKNNSGWKISIRGNRIIWTLTDINGKTKSVFFEYSIREDISDYINRWFFVTITNNLDNAKIYINGKLESNIDIRDIREVIVNGEIIFKLDGEIDRTQFIWMKYFSIFNTELSQSNVKEIYKIQSYSKYLKDFWGNPLMYNKEYYMFNAGNKNSYIKLVKDSSVGEILTRSKYNQNSNYINYRNLYIGEKFIIRRKSSSQSISDDIVRKEDYIYLDFFNSNREWRVYAYKNFKGQEEKLFLANIYDSNEFYKTIQIKEYDEQPTYSCQLLFKKDEESTDEIGLIGIHNFYESGILFKDYKDYFCISKWYLKEVKKKPYSSNLGCNWQFIPKDEGWTE

SEQ ID NO: 16 - protein, 433 aa, Clostridium botulinum
ILNNIILNLRYRDNNLIDLSGYGANVEVYDGVELNDKNQFKLTSSTNSEIRVTQNQNIIVNSMFLDFSVSFWIRIPKYKNDGIQNYIHNEYTIINCMKNNSGWKISIRGNRIIWTLIDINGKIKSVFFEYSIRKDVSEYINRWFFVTITNNLDNAKIYINGKLESNMDIRDIREVIANGEIIFKLDGDIDRTQFIWMKYFSIFNTELSQSNIEEIYKIQSYSEYLKDFWGNPLMYNKEYYMFNAGSKNSYIKLKKDSSVGEILTRSKYNQNSQYINYRDLYIGEKFIIKRKSNSQSINDDIVRKEDYIYLDFFNLNQEWRVYAYKDFKGQKEQKLFLANIHDSNEFYKTIQIKEYDEQPTYSCQLLFKKDEESTDEIGLIGIHRFYESGFVFQEYKYYFCISKWYLKEVKKKPYNPDLGCNWQFIPKDEGWTE

SEQ ID NO: 17 - protein, 1304 aa, Artificial Sequence
  Synthetic polypeptide
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKNILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEEKLFLAPISDSDEFYNTIQIKEYDEQPTYSCQLLFKKDEESTDEIGLIGIHRFYESGIVFEEYKDYFCISKWYLKEVKRKPYNLKLGCNWQFIPKDEGWTE

SEQ ID NO: 18 - protein, 1304 aa, Artificial Sequence
  Synthetic polypeptide
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHDVLNLTRNGYGSTQYIRFSPDFTFGFEESLEVDTNPLLGAGKFATDPAVTLAHELIHAEHRLYGIAINPNRVFKVNTNAYYEMSGLEVSFEELRTFGGHDAKFIDSLQENEFRLYYYNKFKDVASTLNKAKSIIGTTASLQYMKNVFKEKYLLSEDTSGKFSVDKLKFDKLYKMLTEIYTEDNFVNFFKVINRKTYLNFDKAVFRINIVPDENYTIKDGFNLKGANLSTNFNGQNTEINSRNFTRLKNFTGLFEFYKLLCVRGIIPFKTKSLDEGYNKALNDLCIKVNNWDLFFSPSEDNFTNDLDKVEEITADTNIEAAEENISLDLIQQYYLTFDFDNEPENISIENLSSDIIGQLEPMPNIERFPNGKKYELDKYTMFHYLRAQEFEHGDSRIILTNSAEEALLKPNVAYTFFSSKYVKKINKAVEAFMFLNWAEELVYDFTDETNEVTTMDKIADITIIVPYIGPALNIGNMLSKGEFVEAIIFTGVVAMLEFIPEYALPVFGTFAIVSYIANKVLTVQTINNALSKRNEKWDEVYKYTVTNWLAKVNTQIDLIREKMKKALENQAEATKAIINYQYNQYTEEEKNNINFNIDDLSSKLNESINSAMININKFLDQCSVSYLMNSMIPYAVKRLKDFDASVRDVLLKYIYDNRGTLVLQVDRLKDEVNNTLSADIPFQLSKYVDNKKLLSTFTEYIKNILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEEKLFLAPISDSDEFYNTIQIKEYDEQPTYSCQLLFKKDEESTDEIGLIGIHRFYESGIVFEEYKDYFCISKWYLKEVKRKPYNLKLGCNWQFIPKDEGWTE

SEQ ID NO: 19 - protein, 1304 aa, Artificial Sequence
  Synthetic polypeptide
MPFVNKPFNYRDPGNGVDIAYIKIPNAGQMQPVKAFKIHEGVWVIPERDTFTNPEEGDLNPPPEAKQVPVSYYDSTYLSTDNEKDNYLKGVIKLFDRIYSTGLGRMLLSFIVKGIPFWGGSTIDTELKVIDTNCINVIEPGGSYRSEELNLVITGPSADIIQFECKSFGHDVFNLTRNGYGSTQYIRFSPDFTFGFEESLEVDTNPLLGAGTFATDPAVTLAHELIHAAHRLYGIAINPNRVLKVKTNAYYEMSGLEVSFEELRTFGGNDTNFIDSLWQKKFSRDAYDNLQNIARILNEAKTIVGTTTPLQYMKNIFIRKYFLSEDASGKISVNKAAFKEFYRVLTRGFTELEFVNPFKVINRKTYLNFDKAVFRINIVPDENYTINEGFNLEGANSNGQNTEINSRNFTRLKNFTGLFEFYKLLCVRGIIPFKTKSLDEGYNKALNYLCIKVNNWDLFFSPSEDNFTNDLDKVEEITADTNIEAAEENISSDLIQQYYLTFDFDNEPENISIENLSSDIIGQLEPMPNIERFPNGKKYELDKYTMFHYLRAQEFEHGDSRIILTNSAEEALLKPNVAYTFFSSKYVKKINKAVEAVIFLSWAEELVYDFTDETNEVTTMDKIADITIIVPYIGPALNIGNMVSKGEFVEAILFTGVVALLEFIPEYSLPVFGTFAIVSYIANKVLTVQTINNALSKRNEKWDEVYKYTVTNWLAKVNTQIDLIREKMKKALENQAEATRAIINYQYNQYTEEEKNNINFNIDDLSSKLNRSINRAMININKFLDQCSVSYLMNSMIPYAVKRLKDFDASVRDVLLKYIYDNRGTLILQVDRLKDEVNNTLSADIPFQLSKYVNDKKLLSTFTEYIKNIVNTILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEEKLFLAPISDSDEFYNTIQIKEYDEQPTYSCQLLFKKDEESTDEIGLIGIHRFYESGIVFEEYKDYFCISKWYLKEVKRKPYNLKLGCNWQFIPKDEGWTE

SEQ ID NO: 20 - protein, 1304 aa, Artificial Sequence
  Synthetic polypeptide
MPLVNQQINYYDPVNGVDIAYIKIPNAGKMQPVKAFKIHNKVWVIPERDIFTNPEEVDLNPPPEAKQVPISYYDSAYLSTDNEKDNYLKGVIKLFERIYSTDLGRMLLISIVRGIPFWGGGKIDTELKVIDTNCINIIQLDDSYRSEELNLAIIGPSANIIESQCSSFRDDVLNLTRNGYGSTQYIRFSPDFTVGFEESLEVDTNPLLGAGKFAQDPAVALAHELIHAEHRLYGIAINTNRVFKVNTNAYYEMAGLEVSLEELITFGGNDAKFIDSLQKKEFSLYYYNKFKDIASTLNKAKSIVGTTASLQYMKNVFKEKYLLSEDATGKFLVDRLKFDELYKLLTEIYTEDNFVKFFKVLNRKTYLNFDKAVFKINIVPDVNYTIHDGFNLRNTNLAANFNGQNIEINNKNFDKLKNFTGLFEFYKLLCVRGIITSKTKSLDEGYNKALNELCIKVNNWDLFFSPSEDNFTNDLDKVEEITSDTNIEAAEENISLDLIQQYYLNFNFDNEPENTSIENLSSDIIGQLEPMPNIERFPNGKKYELNKYTMFHYLRAQEFKHSNSRIILTNSAKEALLKPNIVYTFFSSKYIKAINKAVEAVTFVNWIENLVYDFTDETNEVSTMDKIADITIVIPYIGPALNIGNMIYKGEFVEAIIFSGAVILLEIVPEIALPVLGTFALVSYVSNKVLTVQTIDNALSKRNEKWDEVYKYIVTNWLAIVNTQINLIREKMKKALENQAEATKAIINYQYNQYTEEEKNNINFNIDDLSSKLNESINSAMININKFLDQCSVSYLMNSMIPYAVKRLKDFDASVRDVLLKYIYDNRGTLIGQVNRLKDKVNNTLSADIPFQLSKYVDNKKLLSTFTEYIKNILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEEKLFLAPISDSDEFYNTIQIKEYDEQPTYSCQLLFKKDEESTDEIGLIGIHRFYESGIVFEEYKDYFCISKWYLKEVKRKPYNLKLGCNWQFIPKDEGWTE

SEQ ID NO: 21 - protein, 1304 aa, Artificial Sequence
  Synthetic polypeptide
MLFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTELGRMLLTSIVRGIPFWGGSTIDTELKVIDTNCINVIQPDGSYRSEELNLVIIGPSADIIQFECKSFGHDVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGEHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPEVNYTIYDGFNLRNTNLAANFNGQNTEINNMNFTKLKNFTGLFEFYKLLCVRGIITSKTKSLDEGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIVLTNSVNEALLNPSSVYTFFSSDYVRKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWGEVYKYIVTNWLAKVNTQIDLIRKKMKEALENQAEATKAIINYQYNQYTEEEKNNINFNIGDLSSKLNDSINKAMININKFLNQCSVSYLMNSMIPYGVKRLEDFDASLKDALLKYIYDNRGTLIGQVDRLKDKVNNTLSTDIPFQLSKYVDNQRLLSTFTEYIKNILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEEKLFLAPISDSDEFYNTIQIKEYDEQPTYSCQLLFKKDEESTDEIGLIGIHRFYESGIVFEEYKDYFCISKWYLKEVKRKPYNLKLGCNWQFIPKDEGWTE

SEQ ID NO: 22 - protein, 1304 aa, Artificial Sequence
  Synthetic polypeptide
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFAKLKNFTGLFEFYKLLCVRGIITSKTKSLDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLSAQEFEHGKSRIDLTNSVNEALLNPSHVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFAIVSYIANKVLTVQTINNALSKRNEKWDEVYKYTVTNWLAKVNTQIDLIREKMKKALENQAEATKAIINYQYNQYTEEEKNNINFNIDDLSSKLNESINSAMININKFLDQCSVSYLMNSMIPYAVKRLKDFDASVRDVLLKYIYDNRGTLIGQVDRLKDKVNNTLSTDIPFQLSKYVDNQRLLSTFTEYIKNILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEEKLFLAPISDSDEFYNTIQIKEYDEQPTYSCQLLFKKDEESTDEIGLIGIHRFYESGIVFEEYKDYFCISKWYLKEVKRKPYNLKLGCNWQFIPKDEGWTE

SEQ ID NO: 23 - protein, 1304 aa, Artificial Sequence
  Synthetic polypeptide
MPFVNKQFNYKDPVNGVDIAYIKIPNAGQMQPVKAFKIHNKIWVIPERDIFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIINFECKSFGHDVLNLTRNGYGSTQYIRFSPDFTFGFEESLEVDTNPLLGAGKFAIDPAVTLAHELIHAGHRLYGIAINPNRVFKVNTNAYYEMSGLEVSFEELRTFGGHDAKFIDSLQENEFRLYYYNKFKEVASILNKAKSIIGTTASLQYMKNVFKEKYLLSEDTSGKFSVDKLRFDKLYKMLTEIYTEDNFVKFFKVLNRKTYLNFDKAVFKMNIVPEVNYTIYDGFNLRNTNLAANFNGQNTEINNMNFTKLKNFTGLFEFYKLLCVRGIITSKTKSLDEGYNKALNDLCIKVNNWDLFFSPSEDNFTNDLNKGEEITSDTNIEAAEENISSDLIQQYYLTFNFDNEPENISIENLSSDIIGQLELMPNIERFPNGKKYELDKYTMFHYLRAQEFEYGNSRIVLINSVNEALLNPSSVYTFFSSDYVKKANEATEAAMFLGWVEQLVYDFTDETSEVSTMDKIADITIIVPYIGPALNIGNMVYKKKFEEALIFSGAVILLEFVPEIVLPILGTFALVSYTSNKVLTVRTIDNALSKRNEKWEEVYKYIVTNWLAKVNTQINLIRKKMKEALENQAEATKAIINYQYNQYTEEEKNNINFNIGDLSSKLNDSINKAMININKFLDQCSVSYLMNSMIPQGVKQLKDFDTSLRDSLLKYIYDNRGTLIGQVDRLKDKVNNTLSTDIPFQLSKYADNQRLLSTFTEYIKNILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEEKLFLAPISDSDEFYNTIQIKEYDEQPTYSCQLLFKKDEESTDEIGLIGIHRFYESGIVFEEYKDYFCISKWYLKEVKRKPYNLKLGCNWQFIPKDEGWTE

SEQ ID NO: 24 - protein, 1304 aa, Artificial Sequence
  Synthetic polypeptide
MPFVNKQFNYKDTVNGIDIAYIKIPNAGQMQPVKAFKIHNKIWVIPERDTFTNPKEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHDVLNLTRNGYGSTQYIRFSPDFTFGFEESLEVDTNPLLGAGKFATDPAVTLAHELIHAEHRLYGIAINPNRVFKVNTNAYYEMSGLEVSFEELRTFGGHNAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPDENYTIKDGFNLKNTNLAANFNGQNTEINSRNFTKLKNFTGLFEFYKLLCVRGIIPFKTKSLDEGYNKALNDLCIKVNNWDLFFSPSEDNFTNDLDKVEEITSDTNIEAAEENISLDLIQQYYLTFDFDNEPENISIENLSSDIIGQLEPMPNIERFPNGKKYELDKYTMFHYLRAQEFEHSKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLVRKKMKEALENQAEATKAIINYQYNQYTEEEKNNINFNIDDLSSKLNESINSAMTNINKFLDQCSVSYLMNSMIPYAVKRLKDFDASVREVLLKYIYDNRGTLILQVDRLKDKVNNTLSADIPFQLSKYVDNKKLLSTFTEYIKNILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEEKLFLAPISDSDEFYNTIQIKEYDEQPTYSCQLLFKKDEESTDEIGLIGIHRFYESGIVFEEYKDYFCISKWYLKEVKRKPYNLKLGCNWQFIPKDEGWTE

SEQ ID NO: 25 - protein, 1291 aa, Artificial Sequence
  Synthetic polypeptide
MPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCKSVKAPGICIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNSEILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEEKLFLAPISDSDEFYNTIQIKEYDEQPTYSCQLLFKKDEESTDEIGLIGIHRFYESGWWFEEYKDYFCISKWYLKEVKRKPYNLKLGCNWQFIPKDEGWTE

SEQ ID NO: 26 - protein, 432 aa, Artificial Sequence
  Synthetic polypeptide
ILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEEKLFLAPISDSDEFYNTIQIKEYDEQPTYSCQLLFKKDEESTDEIGLIGIHRFYESGWWFEEYKDYFCISKWYLKEVKRKPYNLKLGCNWQFIPKDEGWTE

SEQ ID NO: 27 - protein, 1304 aa, Artificial Sequence
  Synthetic polypeptide
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKNILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEEKLFLAPISDSDEFYNTIQIKEYDEQPTYSCQLLFKKDEESTDEIGLIGIHRFYESGWWFEEYKDYFCISKWYLKEVKRKPYNLKLGCNWQFIPKDEGWTE

SEQ ID NO: 28 - protein, 1304 aa, Artificial Sequence
  Synthetic polypeptide
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHDVLNLTRNGYGSTQYIRFSPDFTFGFEESLEVDTNPLLGAGKFATDPAVTLAHELIHAEHRLYGIAINPNRVFKVNTNAYYEMSGLEVSFEELRTFGGHDAKFIDSLQENEFRLYYYNKFKDVASTLNKAKSIIGTTASLQYMKNVFKEKYLLSEDTSGKFSVDKLKFDKLYKMLTEIYTEDNFVNFFKVINRKTYLNFDKAVFRINIVPDENYTIKDGFNLKGANLSTNFNGQNTEINSRNFTRLKNFTGLFEFYKLLCVRGIIPFKTKSLDEGYNKALNDLCIKVNNWDLFFSPSEDNFTNDLDKVEEITADTNIEAAEENISLDLIQQYYLTFDFDNEPENISIENLSSDIIGQLEPMPNIERFPNGKKYELDKYTMFHYLRAQEFEHGDSRIILTNSAEEALLKPNVAYTFFSSKYVKKINKAVEAFMFLNWAEELVYDFTDETNEVTTMDKIADITIIVPYIGPALNIGNMLSKGEFVEAIIFTGVVAMLEFIPEYALPVFGTFAIVSYIANKVLTVQTINNALSKRNEKWDEVYKYTVTNWLAKVNTQIDLIREKMKKALENQAEATKAIINYQYNQYTEEEKNNINFNIDDLSSKLNESINSAMININKFLDQCSVSYLMNSMIPYAVKRLKDFDASVRDVLLKYIYDNRGTLVLQVDRLKDEVNNTLSADIPFQLSKYVDNKKLLSTFTEYIKNILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEEKLFLAPISDSDEFYNTIQIKEYDEQPTYSCQLLFKKDEESTDEIGLIGIHRFYESGWWFEEYKDYFCISKWYLKEVKRKPYNLKLGCNWQFIPKDEGWTE

SEQ ID NO: 29 - protein, 872 aa, Artificial Sequence
  Synthetic polypeptide
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKN

SEQ ID NO: 30 - protein, 872 aa, Artificial Sequence
  Synthetic polypeptide
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHDVLNLTRNGYGSTQYIRFSPDFTFGFEESLEVDTNPLLGAGKFATDPAVTLAHELIHAEHRLYGIAINPNRVFKVNTNAYYEMSGLEVSFEELRTFGGHDAKFIDSLQENEFRLYYYNKFKDVASTLNKAKSIIGTTASLQYMKNVFKEKYLLSEDTSGKFSVDKLKFDKLYKMLTEIYTEDNFVNFFKVINRKTYLNFDKAVFRINIVPDENYTIKDGFNLKGANLSTNFNGQNTEINSRNFTRLKNFTGLFEFYKLLCVRGIIPFKTKSLDEGYNKALNDLCIKVNNWDLFFSPSEDNFTNDLDKVEEITADTNIEAAEENISLDLIQQYYLTFDFDNEPENISIENLSSDIIGQLEPMPNIERFPNGKKYELDKYTMFHYLRAQEFEHGDSRIILTNSAEEALLKPNVAYTFFSSKYVKKINKAVEAFMFLNWAEELVYDFTDETNEVTTMDKIADITIIVPYIGPALNIGNMLSKGEFVEAIIFTGVVAMLEFIPEYALPVFGTFAIVSYIANKVLTVQTINNALSKRNEKWDEVYKYTVTNWLAKVNTQIDLIREKMKKALENQAEATKAIINYQYNQYTEEEKNNINFNIDDLSSKLNESINSAMININKFLDQCSVSYLMNSMIPYAVKRLKDFDASVRDVLLKYIYDNRGTLVLQVDRLKDEVNNTLSADIPFQLSKYVDNKKLLSTFTEYIKN

SEQ ID NO: 31 - protein, 872 aa, Artificial Sequence
  Synthetic polypeptide
MPFVNKPFNYRDPGNGVDIAYIKIPNAGQMQPVKAFKIHEGVWVIPERDTFTNPEEGDLNPPPEAKQVPVSYYDSTYLSTDNEKDNYLKGVIKLFDRIYSTGLGRMLLSFIVKGIPFWGGSTIDTELKVIDTNCINVIEPGGSYRSEELNLVITGPSADIIQFECKSFGHDVFNLTRNGYGSTQYIRFSPDFTFGFEESLEVDTNPLLGAGTFATDPAVTLAHELIHAAHRLYGIAINPNRVLKVKTNAYYEMSGLEVSFEELRTFGGNDTNFIDSLWQKKFSRDAYDNLQNIARILNEAKTIVGTTTPLQYMKNIFIRKYFLSEDASGKISVNKAAFKEFYRVLTRGFTELEFVNPFKVINRKTYLNFDKAVFRINIVPDENYTINEGFNLEGANSNGQNTEINSRNFTRLKNFTGLFEFYKLLCVRGIIPFKTKSLDEGYNKALNYLCIKVNNWDLFFSPSEDNFTNDLDKVEEITADTNIEAAEENISSDLIQQYYLTFDFDNEPENISIENLSSDIIGQLEPMPNIERFPNGKKYELDKYTMFHYLRAQEFEHGDSRIILTNSAEEALLKPNVAYTFFSSKYVKKINKAVEAVIFLSWAEELVYDFTDETNEVTTMDKIADITIIVPYIGPALNIGNMVSKGEFVEAILFTGVVALLEFIPEYSLPVFGTFAIVSYIANKVLTVQTINNALSKRNEKWDEVYKYTVTNWLAKVNTQIDLIREKMKKALENQAEATRAIINYQYNQYTEEEKNNINFNIDDLSSKLNRSINRAMININKFLDQCSVSYLMNSMIPYAVKRLKDFDASVRDVLLKYIYDNRGTLILQVDRLKDEVNNTLSADIPFQLSKYVNDKKLLSTFTEYIKNIVNT

SEQ ID NO: 32 - protein, 872 aa, Artificial Sequence
  Synthetic polypeptide
MPLVNQQINYYDPVNGVDIAYIKIPNAGKMQPVKAFKIHNKVWVIPERDIFTNPEEVDLNPPPEAKQVPISYYDSAYLSTDNEKDNYLKGVIKLFERIYSTDLGRMLLISIVRGIPFWGGGKIDTELKVIDTNCINIIQLDDSYRSEELNLAIIGPSANIIESQCSSFRDDVLNLTRNGYGSTQYIRFSPDFTVGFEESLEVDTNPLLGAGKFAQDPAVALAHELIHAEHRLYGIAINTNRVFKVNTNAYYEMAGLEVSLEELITFGGNDAKFIDSLQKKEFSLYYYNKFKDIASTLNKAKSIVGTTASLQYMKNVFKEKYLLSEDATGKFLVDRLKFDELYKLLTEIYTEDNFVKFFKVLNRKTYLNFDKAVFKINIVPDVNYTIHDGFNLRNTNLAANFNGQNIEINNKNFDKLKNFTGLFEFYKLLCVRGIITSKTKSLDEGYNKALNELCIKVNNWDLFFSPSEDNFTNDLDKVEEITSDTNIEAAEENISLDLIQQYYLNFNFDNEPENTSIENLSSDIIGQLEPMPNIERFPNGKKYELNKYTMFHYLRAQEFKHSNSRIILTNSAKEALLKPNIVYTFFSSKYIKAINKAVEAVTFVNWIENLVYDFTDETNEVSTMDKIADITIVIPYIGPALNIGNMIYKGEFVEAIIFSGAVILLEIVPEIALPVLGTFALVSYVSNKVLTVQTIDNALSKRNEKWDEVYKYIVTNWLAIVNTQINLIREKMKKALENQAEATKAIINYQYNQYTEEEKNNINFNIDDLSSKLNESINSAMININKFLDQCSVSYLMNSMIPYAVKRLKDFDASVRDVLLKYIYDNRGTLIGQVNRLKDKVNNTLSADIPFQLSKYVDNKKLLSTFTEYIKN

SEQ ID NO: 33 - protein, 872 aa, Artificial Sequence
  Synthetic polypeptide
MLFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTELGRMLLTSIVRGIPFWGGSTIDTELKVIDTNCINVIQPDGSYRSEELNLVIIGPSADIIQFECKSFGHDVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGEHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPEVNYTIYDGFNLRNTNLAANFNGQNTEINNMNFTKLKNFTGLFEFYKLLCVRGIITSKTKSLDEGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIVLTNSVNEALLNPSSVYTFFSSDYVRKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWGEVYKYIVTNWLAKVNTQIDLIRKKMKEALENQAEATKAIINYQYNQYTEEEKNNINFNIGDLSSKLNDSINKAMININKFLNQCSVSYLMNSMIPYGVKRLEDFDASLKDALLKYIYDNRGTLIGQVDRLKDKVNNTLSTDIPFQLSKYVDNQRLLSTFTEYIKN

SEQ ID NO: 34 - protein, 872 aa, Artificial Sequence
  Synthetic polypeptide
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFAKLKNFTGLFEFYKLLCVRGIITSKTKSLDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLSAQEFEHGKSRIDLTNSVNEALLNPSHVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFAIVSYIANKVLTVQTINNALSKRNEKWDEVYKYTVTNWLAKVNTQIDLIREKMKKALENQAEATKAIINYQYNQYTEEEKNNINFNIDDLSSKLNESINSAMININKFLDQCSVSYLMNSMIPYAVKRLKDFDASVRDVLLKYIYDNRGTLIGQVDRLKDKVNNTLSTDIPFQLSKYVDNQRLLSTFTEYIKN

SEQ ID NO: 35 - protein, 872 aa, Artificial Sequence
  Synthetic polypeptide
MPFVNKQFNYKDPVNGVDIAYIKIPNAGQMQPVKAFKIHNKIWVIPERDIFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIINFECKSFGHDVLNLTRNGYGSTQYIRFSPDFTFGFEESLEVDTNPLLGAGKFAIDPAVTLAHELIHAGHRLYGIAINPNRVFKVNTNAYYEMSGLEVSFEELRTFGGHDAKFIDSLQENEFRLYYYNKFKEVASILNKAKSIIGTTASLQYMKNVFKEKYLLSEDTSGKFSVDKLRFDKLYKMLTEIYTEDNFVKFFKVLNRKTYLNFDKAVFKMNIVPEVNYTIYDGFNLRNTNLAANFNGQNTEINNMNFTKLKNFTGLFEFYKLLCVRGIITSKTKSLDEGYNKALNDLCIKVNNWDLFFSPSEDNFTNDLNKGEEITSDTNIEAAEENISSDLIQQYYLTFNFDNEPENISIENLSSDIIGQLELMPNIERFPNGKKYELDKYTMFHYLRAQEFEYGNSRIVLINSVNEALLNPSSVYTFFSSDYVKKANEATEAAMFLGWVEQLVYDFTDETSEVSTMDKIADITIIVPYIGPALNIGNMVYKKKFEEALIFSGAVILLEFVPEIVLPILGTFALVSYTSNKVLTVRTIDNALSKRNEKWEEVYKYIVTNWLAKVNTQINLIRKKMKEALENQAEATKAIINYQYNQYTEEEKNNINFNIGDLSSKLNDSINKAMININKFLDQCSVSYLMNSMIPQGVKQLKDFDTSLRDSLLKYIYDNRGTLIGQVDRLKDKVNNTLSTDIPFQLSKYADNQRLLSTFTEYIKN

SEQ ID NO: 36 - protein, 872 aa, Artificial Sequence
  Synthetic polypeptide
MPFVNKQFNYKDTVNGIDIAYIKIPNAGQMQPVKAFKIHNKIWVIPERDTFTNPKEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHDVLNLTRNGYGSTQYIRFSPDFTFGFEESLEVDTNPLLGAGKFATDPAVTLAHELIHAEHRLYGIAINPNRVFKVNTNAYYEMSGLEVSFEELRTFGGHNAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPDENYTIKDGFNLKNTNLAANFNGQNTEINSRNFTKLKNFTGLFEFYKLLCVRGIIPFKTKSLDEGYNKALNDLCIKVNNWDLFFSPSEDNFTNDLDKVEEITSDTNIEAAEENISLDLIQQYYLTFDFDNEPENISIENLSSDIIGQLEPMPNIERFPNGKKYELDKYTMFHYLRAQEFEHSKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLVRKKMKEALENQAEATKAIINYQYNQYTEEEKNNINFNIDDLSSKLNESINSAMTNINKFLDQCSVSYLMNSMIPYAVKRLKDFDASVREVLLKYIYDNRGTLILQVDRLKDKVNNTLSADIPFQLSKYVDNKKLLSTFTEYIKN

SEQ ID NO: 37 - protein, 1291 aa, Artificial Sequence
  Synthetic polypeptide
MPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCKSVKAPGICIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNSEILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEMKLFLAPIYDSDEFYNTIQIKEYDEQPTYSCQLLFKKDEESTDEIGLIGIHRFYESGWWFEEYKDYFCISKWYLKEVKRKPYNLKLGCNWQFIPKDEGWTE

SEQ ID NO: 38 - protein, 1291 aa, Artificial Sequence
  Synthetic polypeptide
MPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCKSVKAPGICIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNSEILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEMKLFLAPIWDSDEFYNTIQIKEYDEQPTYSCQLLFKKDEESTDEIGLIGIHRFYESGWWFEEYKDYFCISKWYLKEVKRKPYNLKLGCNWQFIPKDEGWTE

SEQ ID NO: 39 - protein, 1291 aa, Artificial Sequence
  Synthetic polypeptide
MPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCKSVKAPGICIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNSEILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEQRVYTYKYFKKEEMKLFLAPISDSDEFYNTIQIKEYDEQPTYSCQLLFKKDEESTDEIGLIGIHRFYESGWWFEEYKDYFCISKWYLKEVKRKPYNLKLGCNWQFIPKDEGWTE

SEQ ID NO: 40 - protein, 1291 aa, Artificial Sequence
  Synthetic polypeptide
MPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCKSVKAPGICIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNSEILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEVKLFLAPIYDSDEFYNTIQIKEYDEQPTYSCQLLFKKDEESTDEIGLIGIHRFYESGWWFEEYKDYFCISKWYLKEVKRKPYNLKLGCNWQFIPKDEGWTE

SEQ ID NO: 41 - protein, 1291 aa, Artificial Sequence
  Synthetic polypeptide
MPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCKSVKAPGICIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNSEILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEVKLFLAPIWDSDEFYNTIQIKEYDEQPTYSCQLLFKKDEESTDEIGLIGIHRFYESGWWFEEYKDYFCISKWYLKEVKRKPYNLKLGCNWQFIPKDEGWTE

SEQ ID NO: 42 - protein, 1291 aa, Artificial Sequence
  Synthetic polypeptide
MPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCKSVKAPGICIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNSEILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEQRVYTYKYFKKEEVKLFLAPISDSDEFYNTIQIKEYDEQPTYSCQLLFKKDEESTDEIGLIGIHRFYESGWWFEEYKDYFCISKWYLKEVKRKPYNLKLGCNWQFIPKDEGWTE

SEQ ID NO: 43 - protein, 1291 aa, Artificial Sequence
  Synthetic polypeptide
MPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCKSVKAPGICIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNSEILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEQKLFLAPIYDSDEFYNTIQIKEYDEQPTYSCQLLFKKDEESTDEIGLIGIHRFYESGWWFEEYKDYFCISKWYLKEVKRKPYNLKLGCNWQFIPKDEGWTE

SEQ ID NO: 44 - protein, 432 aa, Artificial Sequence
  Synthetic polypeptide
ILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEMKLFLAPIYDSDEFYNTIQIKEYDEQPTYSCQLLFKKDEESTDEIGLIGIHRFYESGWWFEEYKDYFCISKWYLKEVKRKPYNLKLGCNWQFIPKDEGWTE

SEQ ID NO: 45 - protein, 432 aa, Artificial Sequence
  Synthetic polypeptide
ILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEMKLFLAPIWDSDEFYNTIQIKEYDEQPTYSCQLLFKKDEESTDEIGLIGIHRFYESGWWFEEYKDYFCISKWYLKEVKRKPYNLKLGCNWQFIPKDEGWTE

SEQ ID NO: 46 - protein, 432 aa, Artificial Sequence
  Synthetic polypeptide
ILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEQRVYTYKYFKKEEMKLFLAPISDSDEFYNTIQIKEYDEQPTYSCQLLFKKDEESTDEIGLIGIHRFYESGWWFEEYKDYFCISKWYLKEVKRKPYNLKLGCNWQFIPKDEGWTE

SEQ ID NO: 47 - protein, 432 aa, Artificial Sequence
  Synthetic polypeptide
ILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEQRVYTYKYFKKEEVKLFLAPISDSDEFYNTIQIKEYDEQPTYSCQLLFKKDEESTDEIGLIGIHRFYESGWWFEEYKDYFCISKWYLKEVKRKPYNLKLGCNWQFIPKDEGWTE

SEQ ID NO: 48 - protein, 432 aa, Artificial Sequence
  Synthetic polypeptide
ILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEVKLFLAPIYDSDEFYNTIQIKEYDEQPTYSCQLLFKKDEESTDEIGLIGIHRFYESGWWFEEYKDYFCISKWYLKEVKRKPYNLKLGCNWQFIPKDEGWTE

SEQ ID NO: 49 - protein, 432 aa, Artificial Sequence
  Synthetic polypeptide
ILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEVKLFLAPIWDSDEFYNTIQIKEYDEQPTYSCQLLFKKDEESTDEIGLIGIHRFYESGWWFEEYKDYFCISKWYLKEVKRKPYNLKLGCNWQFIPKDEGWTE

SEQ ID NO: 50 - protein, 432 aa, Artificial Sequence
  Synthetic polypeptide
ILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEQKLFLAPIYDSDEFYNTIQIKEYDEQPTYSCQLLFKKDEESTDEIGLIGIHRFYESGWWFEEYKDYFCISKWYLKEVKRKPYNLKLGCNWQFIPKDEGWTE

SEQ ID NO: 51 - protein, 1304 aa, Artificial Sequence
  Synthetic polypeptide
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKNILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEMKLFLAPIYDSDEFYNTIQIKEYDEQPTYSCQLLFKKDEESTDEIGLIGIHRFYESGWWFEEYKDYFCISKWYLKEVKRKPYNLKLGCNWQFIPKDEGWTE

SEQ ID NO: 52 - protein, 1304 aa, Artificial Sequence
  Synthetic polypeptide
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKNILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEMKLFLAPIWDSDEFYNTIQIKEYDEQPTYSCQLLFKKDEESTDEIGLIGIHRFYESGWWFEEYKDYFCISKWYLKEVKRKPYNLKLGCNWQFIPKDEGWTE

SEQ ID NO: 53 - protein, 1304 aa, Artificial Sequence
  Synthetic polypeptide
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKNILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEQRVYTYKYFKKEEMKLFLAPISDSDEFYNTIQIKEYDEQPTYSCQLLFKKDEESTDEIGLIGIHRFYESGWWFEEYKDYFCISKWYLKEVKRKPYNLKLGCNWQFIPKDEGWTE

SEQ ID NO: 54 - protein, 1304 aa, Artificial Sequence
  Synthetic polypeptide
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKNILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEVKLFLAPIYDSDEFYNTIQIKEYDEQPTYSCQLLFKKDEESTDEIGLIGIHRFYESGWWFEEYKDYFCISKWYLKEVKRKPYNLKLGCNWQFIPKDEGWTE

SEQ ID NO: 55 - protein, 1304 aa, Artificial Sequence
  Synthetic polypeptide
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKNILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEVKLFLAPIWDSDEFYNTIQIKEYDEQPTYSCQLLFKKDEESTDEIGLIGIHRFYESGWWFEEYKDYFCISKWYLKEVKRKPYNLKLGCNWQFIPKDEGWTE

SEQ ID NO: 56 - protein, 1304 aa, Artificial Sequence
  Synthetic polypeptide
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKNILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEQRVYTYKYFKKEEVKLFLAPISDSDEFYNTIQIKEYDEQPTYSCQLLFKKDEESTDEIGLIGIHRFYESGWWFEEYKDYFCISKWYLKEVKRKPYNLKLGCNWQFIPKDEGWTE

SEQ ID NO: 57 - protein, 1304 aa, Artificial Sequence
  Synthetic polypeptide
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKNILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEQKLFLAPIYDSDEFYNTIQIKEYDEQPTYSCQLLFKKDEESTDEIGLIGIHRFYESGWWFEEYKDYFCISKWYLKEVKRKPYNLKLGCNWQFIPKDEGWTE

SEQ ID NO: 58 - protein, 1306 aa, Clostridium botulinum
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPCSLLNGCIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEIEDYEVLNLGAEDGKIKDLSGTTSDINIGSDIELADGRENKAIKIKGSENSTIKIAMNKYLRFSATDNFSISFWIKHPKPTNLLNNGIEYTLVENFNQRGWKISIQDSKLIWYLRDHNNSIKIVTPDYIAFNGWNLITITNNRSKGSIVYVNGSKIEEKDISSIWNTEVDDPIIFRLKNNRDTQAFTLLDQFSIYRKELNQNEVVKLYNYYFNSNYIRDIWGNPLQYNKKYYLQTQDKPGKGLIREYWSSFGYDYVILSDSKTITFPNNIRYGALYNGSKVLIKNSKKLDGLVRNKDFIQLEIDGYNMGISADRFNEDTNYIGTTYGTTHDLTTDFEIIQRQEKYRNYCQLKTPYNIFHKSGLMSTETSKPTFHDYRDWVYSSAWYFQNYENLNLRKHTKTNWYFIPKDEGWDED

SEQ ID NO: 59 - protein, 892 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPCSLLNGCIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEI

SEQ ID NO: 60 - protein, 439 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKN

SEQ ID NO: 61 - protein, 1306 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPSSLLNGCIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEIEDYEVLNLGAEDGKIKDLSGTTSDINIGSDIELADGRENKAIKIKGSENSTIKIAMNKYLRFSATDNFSISFWIKHPKPTNLLNNGIEYTLVENFNQRGWKISIQDSKLIWYLRDHNNSIKIVTPDYIAFNGWNLITITNNRSKGSIVYVNGSKIEEKDISSIWNTEVDDPIIFRLKNNRDTQAFTLLDQFSIYRKELNQNEVVKLYNYYFNSNYIRDIWGNPLQYNKKYYLQTQDKPGKGLIREYWSSFGYDYVILSDSKTITFPNNIRYGALYNGSKVLIKNSKKLDGLVRNKDFIQLEIDGYNMGISADRFNEDTNYIGTTYGTTHDLTTDFEIIQRQEKYRNYCQLKTPYNIFHKSGLMSTETSKPTFHDYRDWVYSSAWYFQNYENLNLRKHTKTNWYFIPKDEGWDED

SEQ ID NO: 62 - protein, 1306 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPASLLNGCIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEIEDYEVLNLGAEDGKIKDLSGTTSDINIGSDIELADGRENKAIKIKGSENSTIKIAMNKYLRFSATDNFSISFWIKHPKPTNLLNNGIEYTLVENFNQRGWKISIQDSKLIWYLRDHNNSIKIVTPDYIAFNGWNLITITNNRSKGSIVYVNGSKIEEKDISSIWNTEVDDPIIFRLKNNRDTQAFTLLDQFSIYRKELNQNEVVKLYNYYFNSNYIRDIWGNPLQYNKKYYLQTQDKPGKGLIREYWSSFGYDYVILSDSKTITFPNNIRYGALYNGSKVLIKNSKKLDGLVRNKDFIQLEIDGYNMGISADRFNEDTNYIGTTYGTTHDLTTDFEIIQRQEKYRNYCQLKTPYNIFHKSGLMSTETSKPTFHDYRDWVYSSAWYFQNYENLNLRKHTKTNWYFIPKDEGWDED

SEQ ID NO: 63 - protein, 1306 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPCSLLNGSIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEIEDYEVLNLGAEDGKIKDLSGTTSDINIGSDIELADGRENKAIKIKGSENSTIKIAMNKYLRFSATDNFSISFWIKHPKPTNLLNNGIEYTLVENFNQRGWKISIQDSKLIWYLRDHNNSIKIVTPDYIAFNGWNLITITNNRSKGSIVYVNGSKIEEKDISSIWNTEVDDPIIFRLKNNRDTQAFTLLDQFSIYRKELNQNEVVKLYNYYFNSNYIRDIWGNPLQYNKKYYLQTQDKPGKGLIREYWSSFGYDYVILSDSKTITFPNNIRYGALYNGSKVLIKNSKKLDGLVRNKDFIQLEIDGYNMGISADRFNEDTNYIGTTYGTTHDLTTDFEIIQRQEKYRNYCQLKTPYNIFHKSGLMSTETSKPTFHDYRDWVYSSAWYFQNYENLNLRKHTKTNWYFIPKDEGWDED

SEQ ID NO: 64 - protein, 1306 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPCSLLNGAIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEIEDYEVLNLGAEDGKIKDLSGTTSDINIGSDIELADGRENKAIKIKGSENSTIKIAMNKYLRFSATDNFSISFWIKHPKPTNLLNNGIEYTLVENFNQRGWKISIQDSKLIWYLRDHNNSIKIVTPDYIAFNGWNLITITNNRSKGSIVYVNGSKIEEKDISSIWNTEVDDPIIFRLKNNRDTQAFTLLDQFSIYRKELNQNEVVKLYNYYFNSNYIRDIWGNPLQYNKKYYLQTQDKPGKGLIREYWSSFGYDYVILSDSKTITFPNNIRYGALYNGSKVLIKNSKKLDGLVRNKDFIQLEIDGYNMGISADRFNEDTNYIGTTYGTTHDLTTDFEIIQRQEKYRNYCQLKTPYNIFHKSGLMSTETSKPTFHDYRDWVYSSAWYFQNYENLNLRKHTKTNWYFIPKDEGWDED

SEQ ID NO: 65 - protein, 1306 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPCSLLNGCIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEIEDYEVLNLGAEDGKIKDLSGTTSDINIGSDIELADGRENKAIKIKGSENSTIKIAMNKYLRFSATDNFSISFWIKHPKPTNLLNNGIEYTLVENFNQRGWKISIQDSKLIWYLRDHNNSIKIVTPDYIAFNGWNLITITNNRSKGSIVYVNGSKIEEKDISSIWNTEVDDPIIFRLKNNRDTQAFTLLDQFSIYRKELNQNEVVKLYNYYFNSNYIRDIWGNPLQYNKKYYLQTQDKPGKGLIREYWSSFGYDYVILSDSKTITFPNNIRYGALYNGSKVLIKNSKKLDGLVRNKDFIQLEIDGYNMGISADRFNEDTNYIGTTYGTTHDLTTDFEIIQRQEKYRNYSQLKTPYNIFHKSGLMSTETSKPTFHDYRDWVYSSAWYFQNYENLNLRKHTKTNWYFIPKDEGWDED

SEQ ID NO: 66 - protein, 1306 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPCSLLNGCIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEIEDYEVLNLGAEDGKIKDLSGTTSDINIGSDIELADGRENKAIKIKGSENSTIKIAMNKYLRFSATDNFSISFWIKHPKPTNLLNNGIEYTLVENFNQRGWKISIQDSKLIWYLRDHNNSIKIVTPDYIAFNGWNLITITNNRSKGSIVYVNGSKIEEKDISSIWNTEVDDPIIFRLKNNRDTQAFTLLDQFSIYRKELNQNEVVKLYNYYFNSNYIRDIWGNPLQYNKKYYLQTQDKPGKGLIREYWSSFGYDYVILSDSKTITFPNNIRYGALYNGSKVLIKNSKKLDGLVRNKDFIQLEIDGYNMGISADRFNEDTNYIGTTYGTTHDLTTDFEIIQRQEKYRNYAQLKTPYNIFHKSGLMSTETSKPTFHDYRDWVYSSAWYFQNYENLNLRKHTKTNWYFIPKDEGWDED

SEQ ID NO: 67 - protein, 1306 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPSSLLNGCIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEIEDYEVLNLGAEDGKIKDLSGTTSDINIGSDIELADGRENKAIKIKGSENSTIKIAMNKYLRFSATDNFSISFWIKHPKPTNLLNNGIEYTLVENFNQRGWKISIQDSKLIWYLRDHNNSIKIVTPDYIAFNGWNLITITNNRSKGSIVYVNGSKIEEKDISSIWNTEVDDPIIFRLKNNRDTQAFTLLDQFSIYRKELNQNEVVKLYNYYFNSNYIRDIWGNPLQYNKKYYLQTQDKPGKGLIREYWSSFGYDYVILSDSKTITFPNNIRYGALYNGSKVLIKNSKKLDGLVRNKDFIQLEIDGYNMGISADRFNEDTNYIGTTYGTTHDLTTDFEIIQRQEKYRNYAQLKTPYNIFHKSGLMSTETSKPTFHDYRDWVYSSAWYFQNYENLNLRKHTKTNWYFIPKDEGWDED

SEQ ID NO: 68 - protein, 1306 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPSSLLNGCIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEIEDYEVLNLGAEDGKIKDLSGTTSDINIGSDIELADGRENKAIKIKGSENSTIKIAMNKYLRFSATDNFSISFWIKHPKPTNLLNNGIEYTLVENFNQRGWKISIQDSKLIWYLRDHNNSIKIVTPDYIAFNGWNLITITNNRSKGSIVYVNGSKIEEKDISSIWNTEVDDPIIFRLKNNRDTQAFTLLDQFSIYRKELNQNEVVKLYNYYFNSNYIRDIWGNPLQYNKKYYLQTQDKPGKGLIREYWSSFGYDYVILSDSKTITFPNNIRYGALYNGSKVLIKNSKKLDGLVRNKDFIQLEIDGYNMGISADRFNEDTNYIGTTYGTTHDLTTDFEIIQRQEKYRNYSQLKTPYNIFHKSGLMSTETSKPTFHDYRDWVYSSAWYFQNYENLNLRKHTKTNWYFIPKDEGWDED

SEQ ID NO: 69 - protein, 1306 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPASLLNGCIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEIEDYEVLNLGAEDGKIKDLSGTTSDINIGSDIELADGRENKAIKIKGSENSTIKIAMNKYLRFSATDNFSISFWIKHPKPTNLLNNGIEYTLVENFNQRGWKISIQDSKLIWYLRDHNNSIKIVTPDYIAFNGWNLITITNNRSKGSIVYVNGSKIEEKDISSIWNTEVDDPIIFRLKNNRDTQAFTLLDQFSIYRKELNQNEVVKLYNYYFNSNYIRDIWGNPLQYNKKYYLQTQDKPGKGLIREYWSSFGYDYVILSDSKTITFPNNIRYGALYNGSKVLIKNSKKLDGLVRNKDFIQLEIDGYNMGISADRFNEDTNYIGTTYGTTHDLTTDFEIIQRQEKYRNYSQLKTPYNIFHKSGLMSTETSKPTFHDYRDWVYSSAWYFQNYENLNLRKHTKTNWYFIPKDEGWDED

SEQ ID NO: 70 - protein, 1306 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPASLLNGCIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEIEDYEVLNLGAEDGKIKDLSGTTSDINIGSDIELADGRENKAIKIKGSENSTIKIAMNKYLRFSATDNFSISFWIKHPKPTNLLNNGIEYTLVENFNQRGWKISIQDSKLIWYLRDHNNSIKIVTPDYIAFNGWNLITITNNRSKGSIVYVNGSKIEEKDISSIWNTEVDDPIIFRLKNNRDTQAFTLLDQFSIYRKELNQNEVVKLYNYYFNSNYIRDIWGNPLQYNKKYYLQTQDKPGKGLIREYWSSFGYDYVILSDSKTITFPNNIRYGALYNGSKVLIKNSKKLDGLVRNKDFIQLEIDGYNMGISADRFNEDTNYIGTTYGTTHDLTTDFEIIQRQEKYRNYAQLKTPYNIFHKSGLMSTETSKPTFHDYRDWVYSSAWYFQNYENLNLRKHTKTNWYFIPKDEGWDED

SEQ ID NO: 71 - protein, 1306 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPCSLLNGSIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEIEDYEVLNLGAEDGKIKDLSGTTSDINIGSDIELADGRENKAIKIKGSENSTIKIAMNKYLRFSATDNFSISFWIKHPKPTNLLNNGIEYTLVENFNQRGWKISIQDSKLIWYLRDHNNSIKIVTPDYIAFNGWNLITITNNRSKGSIVYVNGSKIEEKDISSIWNTEVDDPIIFRLKNNRDTQAFTLLDQFSIYRKELNQNEVVKLYNYYFNSNYIRDIWGNPLQYNKKYYLQTQDKPGKGLIREYWSSFGYDYVILSDSKTITFPNNIRYGALYNGSKVLIKNSKKLDGLVRNKDFIQLEIDGYNMGISADRFNEDTNYIGTTYGTTHDLTTDFEIIQRQEKYRNYAQLKTPYNIFHKSGLMSTETSKPTFHDYRDWVYSSAWYFQNYENLNLRKHTKTNWYFIPKDEGWDED

SEQ ID NO: 72 - protein, 1306 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPCSLLNGSIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEIEDYEVLNLGAEDGKIKDLSGTTSDINIGSDIELADGRENKAIKIKGSENSTIKIAMNKYLRFSATDNFSISFWIKHPKPTNLLNNGIEYTLVENFNQRGWKISIQDSKLIWYLRDHNNSIKIVTPDYIAFNGWNLITITNNRSKGSIVYVNGSKIEEKDISSIWNTEVDDPIIFRLKNNRDTQAFTLLDQFSIYRKELNQNEVVKLYNYYFNSNYIRDIWGNPLQYNKKYYLQTQDKPGKGLIREYWSSFGYDYVILSDSKTITFPNNIRYGALYNGSKVLIKNSKKLDGLVRNKDFIQLEIDGYNMGISADRFNEDTNYIGTTYGTTHDLTTDFEIIQRQEKYRNYSQLKTPYNIFHKSGLMSTETSKPTFHDYRDWVYSSAWYFQNYENLNLRKHTKTNWYFIPKDEGWDED

SEQ ID NO: 73 - protein, 1306 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPCSLLNGAIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEIEDYEVLNLGAEDGKIKDLSGTTSDINIGSDIELADGRENKAIKIKGSENSTIKIAMNKYLRFSATDNFSISFWIKHPKPTNLLNNGIEYTLVENFNQRGWKISIQDSKLIWYLRDHNNSIKIVTPDYIAFNGWNLITITNNRSKGSIVYVNGSKIEEKDISSIWNTEVDDPIIFRLKNNRDTQAFTLLDQFSIYRKELNQNEVVKLYNYYFNSNYIRDIWGNPLQYNKKYYLQTQDKPGKGLIREYWSSFGYDYVILSDSKTITFPNNIRYGALYNGSKVLIKNSKKLDGLVRNKDFIQLEIDGYNMGISADRFNEDTNYIGTTYGTTHDLTTDFEIIQRQEKYRNYSQLKTPYNIFHKSGLMSTETSKPTFHDYRDWVYSSAWYFQNYENLNLRKHTKTNWYFIPKDEGWDED

SEQ ID NO: 74 - protein, 1306 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPCSLLNGAIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEIEDYEVLNLGAEDGKIKDLSGTTSDINIGSDIELADGRENKAIKIKGSENSTIKIAMNKYLRFSATDNFSISFWIKHPKPTNLLNNGIEYTLVENFNQRGWKISIQDSKLIWYLRDHNNSIKIVTPDYIAFNGWNLITITNNRSKGSIVYVNGSKIEEKDISSIWNTEVDDPIIFRLKNNRDTQAFTLLDQFSIYRKELNQNEVVKLYNYYFNSNYIRDIWGNPLQYNKKYYLQTQDKPGKGLIREYWSSFGYDYVILSDSKTITFPNNIRYGALYNGSKVLIKNSKKLDGLVRNKDFIQLEIDGYNMGISADRFNEDTNYIGTTYGTTHDLTTDFEIIQRQEKYRNYAQLKTPYNIFHKSGLMSTETSKPTFHDYRDWVYSSAWYFQNYENLNLRKHTKTNWYFIPKDEGWDED

SEQ ID NO: 75 - protein, 892 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPASLLNGCIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEI

SEQ ID NO: 76 - protein, 892 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPSSLLNGCIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEI

SEQ ID NO: 77 - protein, 892 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPCSLLNGAIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEI

SEQ ID NO: 78 - protein, 892 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPCSLLNGSIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEI

SEQ ID NO: 79 - protein, 1316 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPCSLLNGCIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEIIINTSILNLRYESNHLIDLSRYASKINIGSKVNFDPIDKNQIQLFNLESSKIEVILKNAIVYNSMYENFSTSFWIRIPKYFNSISLNNEYTIINCMENNSGWKVSLNYGEIIWTLQDTQEIKQRVVFKYSQMINISDYINRWIFVTITNNRLNNSKIYINGRLIDQKPISNLGNIHASNNIMFKLDGCRDTHRYIWIKYFNLFDKELNEKEIKDLYDNQSNSGILKDFWGDYLQYDKPYYMLNLYDPNKYVDVNNVGIRGYMYLKGPRGSVMTTNIYLNSSLYRGTKFIIKKYASGNKDNIVRNNDRVYINVVVKNKEYRLATNASQAGVEKILSALEIPDVGNLSQVVVMKSKNDQGITNKCKMNLQDNNGNDIGFIGFHQFNNIAKLVASNWYNRQIERSSRTLGCSWEFIPVDDGWGERPL

SEQ ID NO: 80 - protein, 1324 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPCSLLNGCIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEIILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEEKLFLAPISDSDEFYNTIQIKEYDEQPTYSCQLLFKKDEESTDEIGLIGIHRFYESGIVFEEYKDYFCISKWYLKEVKRKPYNLKLGCNWQFIPKDEGWTE

SEQ ID NO: 81 - protein, 1316 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPCSLLNGCIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEIINDSKILSLQNRKNTLVDTSGYNAEVSEEGDVQLNPIFPFDFKLGSSGEDRGKVIVTQNENIVYNSMYESFSISFWIRINKWVSNLPGYTIIDSVKNNSGWSIGIISNFLVFTLKQNEDSEQSINFSYDISNNAPGYNKWFFVTVTNNMMGNMKIYINGKLIDTIKVKELTGINFSKTITFEINKIPDTGLITSDSDNINMWIRDFYIFAKELDGKDINILFNSLQYTNVVKDYWGNDLRYNKEYYMVNIDYLNRYMYANSRQIVFNTRRNNNDFNEGYKIIIKRIRGNTNDTRVRGGDILYFDMTINNKAYNLFMKNETMYADNHSTEDIYAIGLREQTKDINDNIIFQIQPMNNTYYYASQIFKSNFNGENISGICSIGTYRFRLGGDWYRHNYLVPTVKQGNYASLLESTSTHWGFVPVSE

SEQ ID NO: 82 - protein, 1316 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPSSLLNGCIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEIIINTSILNLRYESNHLIDLSRYASKINIGSKVNFDPIDKNQIQLFNLESSKIEVILKNAIVYNSMYENFSTSFWIRIPKYFNSISLNNEYTIINCMENNSGWKVSLNYGEIIWTLQDTQEIKQRVVFKYSQMINISDYINRWIFVTITNNRLNNSKIYINGRLIDQKPISNLGNIHASNNIMFKLDGCRDTHRYIWIKYFNLFDKELNEKEIKDLYDNQSNSGILKDFWGDYLQYDKPYYMLNLYDPNKYVDVNNVGIRGYMYLKGPRGSVMTTNIYLNSSLYRGTKFIIKKYASGNKDNIVRNNDRVYINVVVKNKEYRLATNASQAGVEKILSALEIPDVGNLSQVVVMKSKNDQGITNKCKMNLQDNNGNDIGFIGFHQFNNIAKLVASNWYNRQIERSSRTLGCSWEFIPVDDGWGERPL

SEQ ID NO: 83 - protein, 1324 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPSSLLNGCIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEIILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEEKLFLAPISDSDEFYNTIQIKEYDEQPTYSCQLLFKKDEESTDEIGLIGIHRFYESGIVFEEYKDYFCISKWYLKEVKRKPYNLKLGCNWQFIPKDEGWTE

SEQ ID NO: 84 - protein, 1316 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPSSLLNGCIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEIINDSKILSLQNRKNTLVDTSGYNAEVSEEGDVQLNPIFPFDFKLGSSGEDRGKVIVTQNENIVYNSMYESFSISFWIRINKWVSNLPGYTIIDSVKNNSGWSIGIISNFLVFTLKQNEDSEQSINFSYDISNNAPGYNKWFFVTVTNNMMGNMKIYINGKLIDTIKVKELTGINFSKTITFEINKIPDTGLITSDSDNINMWIRDFYIFAKELDGKDINILFNSLQYTNVVKDYWGNDLRYNKEYYMVNIDYLNRYMYANSRQIVFNTRRNNNDFNEGYKIIIKRIRGNTNDTRVRGGDILYFDMTINNKAYNLFMKNETMYADNHSTEDIYAIGLREQTKDINDNIIFQIQPMNNTYYYASQIFKSNFNGENISGICSIGTYRFRLGGDWYRHNYLVPTVKQGNYASLLESTSTHWGFVPVSE

SEQ ID NO: 85 - protein, 1316 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPCSLLNGSIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEIIINTSILNLRYESNHLIDLSRYASKINIGSKVNFDPIDKNQIQLFNLESSKIEVILKNAIVYNSMYENFSTSFWIRIPKYFNSISLNNEYTIINCMENNSGWKVSLNYGEIIWTLQDTQEIKQRVVFKYSQMINISDYINRWIFVTITNNRLNNSKIYINGRLIDQKPISNLGNIHASNNIMFKLDGCRDTHRYIWIKYFNLFDKELNEKEIKDLYDNQSNSGILKDFWGDYLQYDKPYYMLNLYDPNKYVDVNNVGIRGYMYLKGPRGSVMTTNIYLNSSLYRGTKFIIKKYASGNKDNIVRNNDRVYINVVVKNKEYRLATNASQAGVEKILSALEIPDVGNLSQVVVMKSKNDQGITNKCKMNLQDNNGNDIGFIGFHQFNNIAKLVASNWYNRQIERSSRTLGCSWEFIPVDDGWGERPL

SEQ ID NO: 86 - protein, 1324 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPCSLLNGSIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEIILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEEKLFLAPISDSDEFYNTIQIKEYDEQPTYSCQLLFKKDEESTDEIGLIGIHRFYESGIVFEEYKDYFCISKWYLKEVKRKPYNLKLGCNWQFIPKDEGWTE

SEQ ID NO: 87 - protein, 1316 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPCSLLNGSIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEIINDSKILSLQNRKNTLVDTSGYNAEVSEEGDVQLNPIFPFDFKLGSSGEDRGKVIVTQNENIVYNSMYESFSISFWIRINKWVSNLPGYTIIDSVKNNSGWSIGIISNFLVFTLKQNEDSEQSINFSYDISNNAPGYNKWFFVTVTNNMMGNMKIYINGKLIDTIKVKELTGINFSKTITFEINKIPDTGLITSDSDNINMWIRDFYIFAKELDGKDINILFNSLQYTNVVKDYWGNDLRYNKEYYMVNIDYLNRYMYANSRQIVFNTRRNNNDFNEGYKIIIKRIRGNTNDTRVRGGDILYFDMTINNKAYNLFMKNETMYADNHSTEDIYAIGLREQTKDINDNIIFQIQPMNNTYYYASQIFKSNFNGENISGICSIGTYRFRLGGDWYRHNYLVPTVKQGNYASLLESTSTHWGFVPVSE

SEQ ID NO: 88 - protein, 1306 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVAKHFLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPCSLLNGCIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEIEDYEVLNLGAEDGKIKDLSGTTSDINIGSDIELADGRENKAIKIKGSENSTIKIAMNKYLRFSATDNFSISFWIKHPKPTNLLNNGIEYTLVENFNQRGWKISIQDSKLIWYLRDHNNSIKIVTPDYIAFNGWNLITITNNRSKGSIVYVNGSKIEEKDISSIWNTEVDDPIIFRLKNNRDTQAFTLLDQFSIYRKELNQNEVVKLYNYYFNSNYIRDIWGNPLQYNKKYYLQTQDKPGKGLIREYWSSFGYDYVILSDSKTITFPNNIRYGALYNGSKVLIKNSKKLDGLVRNKDFIQLEIDGYNMGISADRFNEDTNYIGTTYGTTHDLTTDFEIIQRQEKYRNYCQLKTPYNIFHKSGLMSTETSKPTFHDYRDWVYSSAWYFQNYENLNLRKHTKTNWYFIPKDEGWDED

SEQ ID NO: 89 - protein, 1306 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMYELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPCSLLNGCIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEIEDYEVLNLGAEDGKIKDLSGTTSDINIGSDIELADGRENKAIKIKGSENSTIKIAMNKYLRFSATDNFSISFWIKHPKPTNLLNNGIEYTLVENFNQRGWKISIQDSKLIWYLRDHNNSIKIVTPDYIAFNGWNLITITNNRSKGSIVYVNGSKIEEKDISSIWNTEVDDPIIFRLKNNRDTQAFTLLDQFSIYRKELNQNEVVKLYNYYFNSNYIRDIWGNPLQYNKKYYLQTQDKPGKGLIREYWSSFGYDYVILSDSKTITFPNNIRYGALYNGSKVLIKNSKKLDGLVRNKDFIQLEIDGYNMGISADRFNEDTNYIGTTYGTTHDLTTDFEIIQRQEKYRNYCQLKTPYNIFHKSGLMSTETSKPTFHDYRDWVYSSAWYFQNYENLNLRKHTKTNWYFIPKDEGWDED

SEQ ID NO: 90 - protein, 1306 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHQLVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPCSLLNGCIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEIEDYEVLNLGAEDGKIKDLSGTTSDINIGSDIELADGRENKAIKIKGSENSTIKIAMNKYLRFSATDNFSISFWIKHPKPTNLLNNGIEYTLVENFNQRGWKISIQDSKLIWYLRDHNNSIKIVTPDYIAFNGWNLITITNNRSKGSIVYVNGSKIEEKDISSIWNTEVDDPIIFRLKNNRDTQAFTLLDQFSIYRKELNQNEVVKLYNYYFNSNYIRDIWGNPLQYNKKYYLQTQDKPGKGLIREYWSSFGYDYVILSDSKTITFPNNIRYGALYNGSKVLIKNSKKLDGLVRNKDFIQLEIDGYNMGISADRFNEDTNYIGTTYGTTHDLTTDFEIIQRQEKYRNYCQLKTPYNIFHKSGLMSTETSKPTFHDYRDWVYSSAWYFQNYENLNLRKHTKTNWYFIPKDEGWDED

SEQ ID NO: 91 - protein, 1306 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVYVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPCSLLNGCIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEIEDYEVLNLGAEDGKIKDLSGTTSDINIGSDIELADGRENKAIKIKGSENSTIKIAMNKYLRFSATDNFSISFWIKHPKPTNLLNNGIEYTLVENFNQRGWKISIQDSKLIWYLRDHNNSIKIVTPDYIAFNGWNLITITNNRSKGSIVYVNGSKIEEKDISSIWNTEVDDPIIFRLKNNRDTQAFTLLDQFSIYRKELNQNEVVKLYNYYFNSNYIRDIWGNPLQYNKKYYLQTQDKPGKGLIREYWSSFGYDYVILSDSKTITFPNNIRYGALYNGSKVLIKNSKKLDGLVRNKDFIQLEIDGYNMGISADRFNEDTNYIGTTYGTTHDLTTDFEIIQRQEKYRNYCQLKTPYNIFHKSGLMSTETSKPTFHDYRDWVYSSAWYFQNYENLNLRKHTKTNWYFIPKDEGWDED

SEQ ID NO: 92 - protein, 892 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVAKHFLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPCSLLNGCIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEI

SEQ ID NO: 93 - protein, 892 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMYELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPCSLLNGCIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEI

SEQ ID NO: 94 - protein, 892 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHQLVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPCSLLNGCIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEI

SEQ ID NO: 95 - protein, 892 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVYVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPCSLLNGCIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEI

SEQ ID NO: 96 - protein, 898 aa, Artificial Sequence
  Synthetic polypeptide
MKLEINKFNYNDPIDGINVITMRPPRHSDKINKGKGPFKAFQVIKNIWIVPERYNFTNNTNDLNIPSEPIMEADAIYNPNYLNTPSEKDEFLQGVIKVLERIKSKPEGEKLLELISSSIPLPLVSNGALTLSDNETIAYQENNNIVSNLQANLVIYGPGPDIANNATYGLYSTPISNGEGTLSEVSFSPFYLKPFDESYGNYRSLVNIVNKFVKREFAPDPASTLMHELVHVTHNLYGISNRNFYYNFDTGKIETSRQQNSLIFEELLTFGGIDSKAISSLIIKKIIETAKNNYTTLISERLNTVTVENDLLKYIKNKIPVQGRLGNFKLDTAEFEKKLNTILFVLNESNLAQRFSILVRKHYLKERPIDPIYVNILDDNSYSTLEGFNISSQGSNDFQGQLLESSYFEKIESNALRAFIKICPRNGLLYNAIYRNSKNYLNNIDLEDKKTTSKTNVSYPCSLLNGCIEVENKDLFLISNKDSLNDINLSEEKIKPETTVFFKDKLPPQDITLSNYDFTEANSIPSISQQNILERNEELYEPIRNSLFEIKTIYVDKLTTFHFLEAQNIDESIDSSKIRVELTDSVDEALSNPNKVYSPFKNMSNTINSIETGITSTYIFYQWLRSIVKDFSDETGKIDVIDKSSDTLAIVPYIGPLLNIGNDIRHGDFVGAIELAGITALLEYVPEFTIPILVGLEVIGGELAREQVEAIVNNALDKRDQKWAEVYNITKAQWWGTIHLQINTRLAHTYKALSRQANAIKMNMEFQLANYKGNIDDKAKIKNAISETEILLNKSVEQAMKNTEKFMIKLSNSYLTKEMIPKVQDNLKNFDLETKKTLDKFIKEKEDILGTNLSSSLRRKVSIRLNKNIAFDINDIPFSEFDDLINQYKNEILPETGG

SEQ ID NO: 97 - protein, 415 aa, Artificial Sequence
  Synthetic polypeptide
GEDYEVLNLGAEDGKIKDLSGTTSDINIGSDIELADGRENKAIKIKGSENSTIKIAMNKYLRFSATDNFSISFWIKHPKPTNLLNNGIEYTLVENFNQRGWKISIQDSKLIWYLRDHNNSIKIVTPDYIAFNGWNLITITNNRSKGSIVYVNGSKIEEKDISSIWNTEVDDPIIFRLKNNRDTQAFTLLDQFSIYRKELNQNEVVKLYNYYFNSNYIRDIWGNPLQYNKKYYLQTQDKPGKGLIREYWSSFGYDYVILSDSKTITFPNNIRYGALYNGSKVLIKNSKKLDGLVRNKDFIQLEIDGYNMGISADRFNEDTNYIGTTYGTTHDLTTDFEIIQRQEKYRNYCQLKTPYNIFHKSGLMSTETSKPTFHDYRDWVYSSAWYFQNYENLNLRKHTKTNWYFIPKDEGWDED

SEQ ID NO: 98 - protein, 424 aa, Artificial Sequence
  Synthetic polypeptide
IINTSILNLRYESNHLIDLSRYASKINIGSKVNFDPIDKNQIQLFNLESSKIEVILKNAIVYNSMYENFSTSFWIRIPKYFNSISLNNEYTIINCMENNSGWKVSLNYGEIIWTLQDTQEIKQRVVFKYSQMINISDYINRWIFVTITNNRLNNSKIYINGRLIDQKPISNLGNIHASNNIMFKLDGCRDTHRYIWIKYFNLFDKELNEKEIKDLYDNQSNSGILKDFWGDYLQYDKPYYMLNLYDPNKYVDVNNVGIRGYMYLKGPRGSVMTTNIYLNSSLYRGTKFIIKKYASGNKDNIVRNNDRVYINVVVKNKEYRLATNASQAGVEKILSALEIPDVGNLSQVVVMKSKNDQGITNKCKMNLQDNNGNDIGFIGFHQFNNIAKLVASNWYNRQIERSSRTLGCSWEFIPVDDGWGERPL

SEQ ID NO: 99 - protein, 432 aa, Artificial Sequence; identical to SEQ ID NO: 9
  Synthetic polypeptide

SEQ ID NO: 100 - protein, 424 aa, Artificial Sequence
  Synthetic polypeptide
INDSKILSLQNRKNTLVDTSGYNAEVSEEGDVQLNPIFPFDFKLGSSGEDRGKVIVTQNENIVYNSMYESFSISFWIRINKWVSNLPGYTIIDSVKNNSGWSIGIISNFLVFTLKQNEDSEQSINFSYDISNNAPGYNKWFFVTVTNNMMGNMKIYINGKLIDTIKVKELTGINFSKTITFEINKIPDTGLITSDSDNINMWIRDFYIFAKELDGKDINILFNSLQYTNVVKDYWGNDLRYNKEYYMVNIDYLNRYMYANSRQIVFNTRRNNNDFNEGYKIIIKRIRGNTNDTRVRGGDILYFDMTINNKAYNLFMKNETMYADNHSTEDIYAIGLREQTKDINDNIIFQIQPMNNTYYYASQIFKSNFNGENISGICSIGTYRFRLGGDWYRHNYLVPTVKQGNYASLLESTSTHWGFVPVSE

SEQ ID NO: 101 - protein, 866 aa, Artificial Sequence
  Synthetic polypeptide
MVTINDLHYSDPIDEDNIINMRIPLYDLEVDDQFINHNVPDLKAFQVFPNVWVVPERYTFYSTMKNLDAPANPSRSSYYDPTYLQSDAEKEVFLQQMILLFKRINSTQEGQQFLNLLSRSIPVPYESNGDVAMGTTQVIKQMDDKGNVLKHRRAHIIIYGPGPDLMAKGSKALTKSRETGRGCMAEIYFSPMYHKTYSTKLTNKNSLVDKSVQEFVPDPAVTLIHELCHGLHALYGIDLGNVGSWEFNSNPNSLFSSWFSSKEAVNFEEVMTFGGEDVKVIKSEIDKKIPGILNLIKTTVEPIINKITDPHDEMLQCLQSKYPSLKGTLGQFFFDDTQLEKDIRDLWMVMNETMFAENLKALTRARYLVPKVENIVQVDILSPNVYTIDKGFNHLSKGFKGQSVSQSYFRKISALARGAVVRACPNPHFSSQLVPRGSLSSCIEILEDDLFIMSSKDSFTDTDFSEPSVGPVSYKAKKGADTILDSTLSNYDFSKEINFTSTVPIITVEDPLETDEDVPVISEDRTVYVDDYTTFHFLEAQKIGKEVVPTQTKVVFTTNMEEALFDSKKVYTVFENTASRINEAGTGIANGMMFYQWLKGIVQDFTEEATQKDTFDKISDVTMIVPYLGNILNIGNDIRKGDFMGAVELGGVTILLEAIPELTLPVLIGLTIIEDELEKEQVSQTVYNVLDKRDEKWEEVYGFVKQQWWWMVHTQFETRILHAYQALNHQVEAIKANMTYQLANYRGNQEDKELLEKAIDDTLQSLYYAVDQAMHNIKRFLIQSSKSYLLNQMLPKTKEQLLAFDQQTLRNVNDFINKNQGVLGESLAKDLKKKVEKRLTSLPVFNLEDLPISEFEDLIHSHEIDI

SEQ ID NO: 102 - protein, 872 aa, Artificial Sequence
  Synthetic polypeptide
MVTINDLHYSDPIDEDNIINMRIPLYDLEVDDQFINHNVPDLKAFQVFPNVWVVPERYTFYSTMKNLDAPANPSRSSYYDPTYLQSDAEKEVFLQQMILLFKRINSTQEGQQFLNLLSRSIPVPYESNGDVAMGTTQVIKQMDDKGNVLKHRRAHIIIYGPGPDLMAKGSKALTKSRETGRGCMAEIYFSPMYHKTYSTKLTNKNSLVDKSVQEFVPDPAVTLIHELCHGLHALYGIDLGNVGSWEFNSNPNSLFSSWFSSKEAVNFEEVMTFGGEDVKVIKSEIDKKIPGILNLIKTTVEPIINKITDPHDEMLQCLQSKYPSLKGTLGQFFFDDTQLEKDIRDLWMVMNETMFAENLKALTRARYLVPKVENIVQVDILSPNVYTIDKGFNHLSKGFKGQSVSQSYFRKISALARGAVVRACVRGIITSKTKSLDKGYNKALNDLCIEILEDDLFIMSSKDSFTDTDFSEPSVGPVSYKAKKGADTILDSTLSNYDFSKEINFTSTVPIITVEDPLETDEDVPVISEDRTVYVDDYTTFHFLEAQKIGKEVVPTQTKVVFTTNMEEALFDSKKVYTVFENTASRINEAGTGIANGMMFYQWLKGIVQDFTEEATQKDTFDKISDVTMIVPYLGNILNIGNDIRKGDFMGAVELGGVTILLEAIPELTLPVLIGLTIIEDELEKEQVSQTVYNVLDKRDEKWEEVYGFVKQQWWWMVHTQFETRILHAYQALNHQVEAIKANMTYQLANYRGNQEDKELLEKAIDDTLQSLYYAVDQAMHNIKRFLIQSSKSYLLNQMLPKTKEQLLAFDQQTLRNVNDFINKNQGVLGESLAKDLKKKVEKRLTSLPVFNLEDLPISEFEDLIHSHEIDI

SEQ ID NO: 103 - protein, 857 aa, Artificial Sequence
  Synthetic polypeptide
MVTINDLHYSDPIDEDNIINMRIPLYDLEVDDQFINHNVPDLKAFQVFPNVWVVPERYTFYSTMKNLDAPANPSRSSYYDPTYLQSDAEKEVFLQQMILLFKRINSTQEGQQFLNLLSRSIPVPYESNGDVAMGTTQVIKQMDDKGNVLKHRRAHIIIYGPGPDLMAKGSKALTKSRETGRGCMAEIYFSPMYHKTYSTKLTNKNSLVDKSVQEFVPDPAVTLIHELCHGLHALYGIDLGNVGSWEFNSNPNSLFSSWFSSKEAVNFEEVMTFGGEDVKVIKSEIDKKIPGILNLIKTTVEPIINKITDPHDEMLQCLQSKYPSLKGTLGQFFFDDTQLEKDIRDLWMVMNETMFAENLKALTRARYLVPKVENIVQVDILSPNVYTIDKGFNHLSKGFKGQSVSQSYFRKISALARGAVVRACKSVKAPGICIEILEDDLFIMSSKDSFTDTDFSEPSVGPVSYKAKKGADTILDSTLSNYDFSKEINFTSTVPIITVEDPLETDEDVPVISEDRTVYVDDYTTFHFLEAQKIGKEVVPTQTKVVFTTNMEEALFDSKKVYTVFENTASRINEAGTGIANGMMFYQWLKGIVQDFTEEATQKDTFDKISDVTMIVPYLGNILNIGNDIRKGDFMGAVELGGVTILLEAIPELTLPVLIGLTIIEDELEKEQVSQTVYNVLDKRDEKWEEVYGFVKQQWWWMVHTQFETRILHAYQALNHQVEAIKANMTYQLANYRGNQEDKELLEKAIDDTLQSLYYAVDQAMHNIKRFLIQSSKSYLLNQMLPKTKEQLLAFDQQTLRNVNDFINKNQGVLGESLAKDLKKKVEKRLTSLPVFNLEDLPISEFEDLIHSHEIDI

SEQ ID NO: 104 - protein, 864 aa, Artificial Sequence
  Synthetic polypeptide
MVTINDLHYSDPIDEDNIINMRIPLYDLEVDDQFINHNVPDLKAFQVFPNVWVVPERYTFYSTMKNLDAPANPSRSSYYDPTYLQSDAEKEVFLQQMILLFKRINSTQEGQQFLNLLSRSIPVPYESNGDVAMGTTQVIKQMDDKGNVLKHRRAHIIIYGPGPDLMAKGSKALTKSRETGRGCMAEIYFSPMYHKTYSTKLTNKNSLVDKSVQEFVPDPAVTLIHELCHGLHALYGIDLGNVGSWEFNSNPNSLFSSWFSSKEAVNFEEVMTFGGEDVKVIKSEIDKKIPGILNLIKTTVEPIINKITDPHDEMLQCLQSKYPSLKGTLGQFFFDDTQLEKDIRDLWMVMNETMFAENLKALTRARYLVPKVENIVQVDILSPNVYTIDKGFNHLSKGFKGQSVSQSYFRKISALARGAVVRACHKAIDGRSLYNKTLDCIEILEDDLFIMSSKDSFTDTDFSEPSVGPVSYKAKKGADTILDSTLSNYDFSKEINFTSTVPIITVEDPLETDEDVPVISEDRTVYVDDYTTFHFLEAQKIGKEVVPTQTKVVFTTNMEEALFDSKKVYTVFENTASRINEAGTGIANGMMFYQWLKGIVQDFTEEATQKDTFDKISDVTMIVPYLGNILNIGNDIRKGDFMGAVELGGVTILLEAIPELTLPVLIGLTIIEDELEKEQVSQTVYNVLDKRDEKWEEVYGFVKQQWWWMVHTQFETRILHAYQALNHQVEAIKANMTYQLANYRGNQEDKELLEKAIDDTLQSLYYAVDQAMHNIKRFLIQSSKSYLLNQMLPKTKEQLLAFDQQTLRNVNDFINKNQGVLGESLAKDLKKKVEKRLTSLPVFNLEDLPISEFEDLIHSHEIDI

SEQ ID NO: 105 - protein, 861 aa, Artificial Sequence
  Synthetic polypeptide
MVTINDLHYSDPIDEDNIINMRIPLYDLEVDDQFINHNVPDLKAFQVFPNVWVVPERYTFYSTMKNLDAPANPSRSSYYDPTYLQSDAEKEVFLQQMILLFKRINSTQEGQQFLNLLSRSIPVPYESNGDVAMGTTQVIKQMDDKGNVLKHRRAHIIIYGPGPDLMAKGSKALTKSRETGRGCMAEIYFSPMYHKTYSTKLTNKNSLVDKSVQEFVPDPAVTLIHELCHGLHALYGIDLGNVGSWEFNSNPNSLFSSWFSSKEAVNFEEVMTFGGEDVKVIKSEIDKKIPGILNLIKTTVEPIINKITDPHDEMLQCLQSKYPSLKGTLGQFFFDDTQLEKDIRDLWMVMNETMFAENLKALTRARYLVPKVENIVQVDILSPNVYTIDKGFNHLSKGFKGQSVSQSYFRKISALARGAVVRACLRLTKNSRDDSTCIEILEDDLFIMSSKDSFTDTDFSEPSVGPVSYKAKKGADTILDSTLSNYDFSKEINFTSTVPIITVEDPLETDEDVPVISEDRTVYVDDYTTFHFLEAQKIGKEVVPTQTKVVFTTNMEEALFDSKKVYTVFENTASRINEAGTGIANGMMFYQWLKGIVQDFTEEATQKDTFDKISDVTMIVPYLGNILNIGNDIRKGDFMGAVELGGVTILLEAIPELTLPVLIGLTIIEDELEKEQVSQTVYNVLDKRDEKWEEVYGFVKQQWWWMVHTQFETRILHAYQALNHQVEAIKANMTYQLANYRGNQEDKELLEKAIDDTLQSLYYAVDQAMHNIKRFLIQSSKSYLLNQMLPKTKEQLLAFDQQTLRNVNDFINKNQGVLGESLAKDLKKKVEKRLTSLPVFNLEDLPISEFEDLIHSHEIDI

SEQ ID NO: 106 - protein, 862 aa, Artificial Sequence
  Synthetic polypeptide
MVTINDLHYSDPIDEDNIINMRIPLYDLEVDDQFINHNVPDLKAFQVFPNVWVVPERYTFYSTMKNLDAPANPSRSSYYDPTYLQSDAEKEVFLQQMILLFKRINSTQEGQQFLNLLSRSIPVPYESNGDVAMGTTQVIKQMDDKGNVLKHRRAHIIIYGPGPDLMAKGSKALTKSRETGRGCMAEIYFSPMYHKTYSTKLTNKNSLVDKSVQEFVPDPAVTLIHELCHGLHALYGIDLGNVGSWEFNSNPNSLFSSWFSSKEAVNFEEVMTFGGEDVKVIKSEIDKKIPGILNLIKTTVEPIINKITDPHDEMLQCLQSKYPSLKGTLGQFFFDDTQLEKDIRDLWMVMNETMFAENLKALTRARYLVPKVENIVQVDILSPNVYTIDKGFNHLSKGFKGQSVSQSYFRKISALARGAVVRACKNIVSVKGIRKSICIEILEDDLFIMSSKDSFTDTDFSEPSVGPVSYKAKKGADTILDSTLSNYDFSKEINFTSTVPIITVEDPLETDEDVPVISEDRTVYVDDYTTFHFLEAQKIGKEVVPTQTKVVFTTNMEEALFDSKKVYTVFENTASRINEAGTGIANGMMFYQWLKGIVQDFTEEATQKDTFDKISDVTMIVPYLGNILNIGNDIRKGDFMGAVELGGVTILLEAIPELTLPVLIGLTIIEDELEKEQVSQTVYNVLDKRDEKWEEVYGFVKQQWWWMVHTQFETRILHAYQALNHQVEAIKANMTYQLANYRGNQEDKELLEKAIDDTLQSLYYAVDQAMHNIKRFLIQSSKSYLLNQMLPKTKEQLLAFDQQTLRNVNDFINKNQGVLGESLAKDLKKKVEKRLTSLPVFNLEDLPISEFEDLIHSHEIDI

SEQ ID NO: 107 - protein, 864 aa, Artificial Sequence
  Synthetic polypeptide
MVTINDLHYSDPIDEDNIINMRIPLYDLEVDDQFINHNVPDLKAFQVFPNVWVVPERYTFYSTMKNLDAPANPSRSSYYDPTYLQSDAEKEVFLQQMILLFKRINSTQEGQQFLNLLSRSIPVPYESNGDVAMGTTQVIKQMDDKGNVLKHRRAHIIIYGPGPDLMAKGSKALTKSRETGRGCMAEIYFSPMYHKTYSTKLTNKNSLVDKSVQEFVPDPAVTLIHELCHGLHALYGIDLGNVGSWEFNSNPNSLFSSWFSSKEAVNFEEVMTFGGEDVKVIKSEIDKKIPGILNLIKTTVEPIINKITDPHDEMLQCLQSKYPSLKGTLGQFFFDDTQLEKDIRDLWMVMNETMFAENLKALTRARYLVPKVENIVQVDILSPNVYTIDKGFNHLSKGFKGQSVSQSYFRKISALARGAVVRACKSVIPRKGTKAPPRLCIEILEDDLFIMSSKDSFTDTDFSEPSVGPVSYKAKKGADTILDSTLSNYDFSKEINFTSTVPIITVEDPLETDEDVPVISEDRTVYVDDYTTFHFLEAQKIGKEVVPTQTKVVFTTNMEEALFDSKKVYTVFENTASRINEAGTGIANGMMFYQWLKGIVQDFTEEATQKDTFDKISDVTMIVPYLGNILNIGNDIRKGDFMGAVELGGVTILLEAIPELTLPVLIGLTIIEDELEKEQVSQTVYNVLDKRDEKWEEVYGFVKQQWWWMVHTQFETRILHAYQALNHQVEAIKANMTYQLANYRGNQEDKELLEKAIDDTLQSLYYAVDQAMHNIKRFLIQSSKSYLLNQMLPKTKEQLLAFDQQTLRNVNDFINKNQGVLGESLAKDLKKKVEKRLTSLPVFNLEDLPISEFEDLIHSHEIDI

SEQ ID NO: 108 - protein, 862 aa, Artificial Sequence
  Synthetic polypeptide
MVTINDLHYSDPIDEDNIINMRIPLYDLEVDDQFINHNVPDLKAFQVFPNVWVVPERYTFYSTMKNLDAPANPSRSSYYDPTYLQSDAEKEVFLQQMILLFKRINSTQEGQQFLNLLSRSIPVPYESNGDVAMGTTQVIKQMDDKGNVLKHRRAHIIIYGPGPDLMAKGSKALTKSRETGRGCMAEIYFSPMYHKTYSTKLTNKNSLVDKSVQEFVPDPAVTLIHELCHGLHALYGIDLGNVGSWEFNSNPNSLFSSWFSSKEAVNFEEVMTFGGEDVKVIKSEIDKKIPGILNLIKTTVEPIINKITDPHDEMLQCLQSKYPSLKGTLGQFFFDDTQLEKDIRDLWMVMNETMFAENLKALTRARYLVPKVENIVQVDILSPNVYTIDKGFNHLSKGFKGQSVSQSYFRKISALARGAVVRACKPVMYKNTGKSEQCIEILEDDLFIMSSKDSFTDTDFSEPSVGPVSYKAKKGADTILDSTLSNYDFSKEINFTSTVPIITVEDPLETDEDVPVISEDRTVYVDDYTTFHFLEAQKIGKEVVPTQTKVVFTTNMEEALFDSKKVYTVFENTASRINEAGTGIANGMMFYQWLKGIVQDFTEEATQKDTFDKISDVTMIVPYLGNILNIGNDIRKGDFMGAVELGGVTILLEAIPELTLPVLIGLTIIEDELEKEQVSQTVYNVLDKRDEKWEEVYGFVKQQWWWMVHTQFETRILHAYQALNHQVEAIKANMTYQLANYRGNQEDKELLEKAIDDTLQSLYYAVDQAMHNIKRFLIQSSKSYLLNQMLPKTKEQLLAFDQQTLRNVNDFINKNQGVLGESLAKDLKKKVEKRLTSLPVFNLEDLPISEFEDLIHSHEIDI

SEQ ID NO: 109 - protein, 892 aa, Artificial Sequence
  Synthetic polypeptide
MVTINDLHYSDPIDEDNIINMRIPLYDLEVDDQFINHNVPDLKAFQVFPNVWVVPERYTFYSTMKNLDAPANPSRSSYYDPTYLQSDAEKEVFLQQMILLFKRINSTQEGQQFLNLLSRSIPVPYESNGDVAMGTTQVIKQMDDKGNVLKHRRAHIIIYGPGPDLMAKGSKALTKSRETGRGCMAEIYFSPMYHKTYSTKLTNKNSLVDKSVQEFVPDPAVTLIHELCHGLHALYGIDLGNVGSWEFNSNPNSLFSSWFSSKEAVNFEEVMTFGGEDVKVIKSEIDKKIPGILNLIKTTVEPIINKITDPHDEMLQCLQSKYPSLKGTLGQFFFDDTQLEKDIRDLWMVMNETMFAENLKALTRARYLVPKVENIVQVDILSPNVYTIDKGFNHLSKGFKGQSVSQSYFRKISALARGAVVRACPRNGLLYNAIYRNSKNYLNNIDLEDKKTTSKTNVSYPCSLLNGCIEILEDDLFIMSSKDSFTDTDFSEPSVGPVSYKAKKGADTILDSTLSNYDFSKEINFTSTVPIITVEDPLETDEDVPVISEDRTVYVDDYTTFHFLEAQKIGKEVVPTQTKVVFTTNMEEALFDSKKVYTVFENTASRINEAGTGIANGMMFYQWLKGIVQDFTEEATQKDTFDKISDVTMIVPYLGNILNIGNDIRKGDFMGAVELGGVTILLEAIPELTLPVLIGLTIIEDELEKEQVSQTVYNVLDKRDEKWEEVYGFVKQQWWWMVHTQFETRILHAYQALNHQVEAIKANMTYQLANYRGNQEDKELLEKAIDDTLQSLYYAVDQAMHNIKRFLIQSSKSYLLNQMLPKTKEQLLAFDQQTLRNVNDFINKNQGVLGESLAKDLKKKVEKRLTSLPVFNLEDLPISEFEDLIHSHEIDI

SEQ ID NO: 110 - protein, 1283 aa, Artificial Sequence
  Synthetic polypeptide
MVTINDLHYSDPIDEDNIINMRIPLYDLEVDDQFINHNVPDLKAFQVFPNVWVVPERYTFYSTMKNLDAPANPSRSSYYDPTYLQSDAEKEVFLQQMILLFKRINSTQEGQQFLNLLSRSIPVPYESNGDVAMGTTQVIKQMDDKGNVLKHRRAHIIIYGPGPDLMAKGSKALTKSRETGRGCMAEIYFSPMYHKTYSTKLTNKNSLVDKSVQEFVPDPAVTLIHELCHGLHALYGIDLGNVGSWEFNSNPNSLFSSWFSSKEAVNFEEVMTFGGEDVKVIKSEIDKKIPGILNLIKTTVEPIINKITDPHDEMLQCLQSKYPSLKGTLGQFFFDDTQLEKDIRDLWMVMNETMFAENLKALTRARYLVPKVENIVQVDILSPNVYTIDKGFNHLSKGFKGQSVSQSYFRKISALARGAVVRACPNPHFSSQLVPRGSLSSCIEILEDDLFIMSSKDSFTDTDFSEPSVGPVSYKAKKGADTILDSTLSNYDFSKEINFTSTVPIITVEDPLETDEDVPVISEDRTVYVDDYTTFHFLEAQKIGKEVVPTQTKVVFTTNMEEALFDSKKVYTVFENTASRINEAGTGIANGMMFYQWLKGIVQDFTEEATQKDTFDKISDVTMIVPYLGNILNIGNDIRKGDFMGAVELGGVTILLEAIPELTLPVLIGLTIIEDELEKEQVSQTVYNVLDKRDEKWEEVYGFVKQQWWWMVHTQFETRILHAYQALNHQVEAIKANMTYQLANYRGNQEDKELLEKAIDDTLQSLYYAVDQAMHNIKRFLIQSSKSYLLNQMLPKTKEQLLAFDQQTLRNVNDFINKNQGVLGESLAKDLKKKVEKRLTSLPVFNLEDLPISEFEDLIHSHEIDIQDSEVLNIGVNNGKIQDLSGENTPLTLGENLHIVNGRDNQAVRLNNQLDSKLEIQSRPNIHFTAFEDFSISIWIRCSMLRNNRNRGQKYTIIQQFNKYGWQLAIQDSVFVWTLHDTFNNQIQLTSGSALTNKNYLLQNFWLHITVTNKRSEKSRLYINGVLQDQKDISVLGNCHPKEPILFSIQDNSDPNYFVRFEQFNVYRKALTDSEVNRLYWKYFEGSYLRDVWGERLTYNRDYYMQLSTLPGRGIKREYRTWSGFDYIILSELGTQKIPTHEVTYPKLYQGQKITIHSDGKNLEPHVKSNKNIRLKIDDFYIGVVNPFKLPEWRPESGAYVVTTYNHAEDLCLYFRTRSSSQSLYYGQLIMNDGRNKSLLNYTLKGSTYWIWSSAWYYENYNTSSKTAGNWYFIPVDEGWKED

SEQ ID NO: 111 - protein, 1289 aa, Artificial Sequence
  Synthetic polypeptide
MVTINDLHYSDPIDEDNIINMRIPLYDLEVDDQFINHNVPDLKAFQVFPNVWVVPERYTFYSTMKNLDAPANPSRSSYYDPTYLQSDAEKEVFLQQMILLFKRINSTQEGQQFLNLLSRSIPVPYESNGDVAMGTTQVIKQMDDKGNVLKHRRAHIIIYGPGPDLMAKGSKALTKSRETGRGCMAEIYFSPMYHKTYSTKLTNKNSLVDKSVQEFVPDPAVTLIHELCHGLHALYGIDLGNVGSWEFNSNPNSLFSSWFSSKEAVNFEEVMTFGGEDVKVIKSEIDKKIPGILNLIKTTVEPIINKITDPHDEMLQCLQSKYPSLKGTLGQFFFDDTQLEKDIRDLWMVMNETMFAENLKALTRARYLVPKVENIVQVDILSPNVYTIDKGFNHLSKGFKGQSVSQSYFRKISALARGAVVRACVRGIITSKTKSLDKGYNKALNDLCIEILEDDLFIMSSKDSFTDTDFSEPSVGPVSYKAKKGADTILDSTLSNYDFSKEINFTSTVPIITVEDPLETDEDVPVISEDRTVYVDDYTTFHFLEAQKIGKEVVPTQTKVVFTTNMEEALFDSKKVYTVFENTASRINEAGTGIANGMMFYQWLKGIVQDFTEEATQKDTFDKISDVTMIVPYLGNILNIGNDIRKGDFMGAVELGGVTILLEAIPELTLPVLIGLTIIEDELEKEQVSQTVYNVLDKRDEKWEEVYGFVKQQWWWMVHTQFETRILHAYQALNHQVEAIKANMTYQLANYRGNQEDKELLEKAIDDTLQSLYYAVDQAMHNIKRFLIQSSKSYLLNQMLPKTKEQLLAFDQQTLRNVNDFINKNQGVLGESLAKDLKKKVEKRLTSLPVFNLEDLPISEFEDLIHSHEIDIQDSEVLNIGVNNGKIQDLSGENTPLTLGENLHIVNGRDNQAVRLNNQLDSKLEIQSRPNIHFTAFEDFSISIWIRCSMLRNNRNRGQKYTIIQQFNKYGWQLAIQDSVFVWTLHDTFNNQIQLTSGSALTNKNYLLQNFWLHITVTNKRSEKSRLYINGVLQDQKDISVLGNCHPKEPILFSIQDNSDPNYFVRFEQFNVYRKALTDSEVNRLYWKYFEGSYLRDVWGERLTYNRDYYMQLSTLPGRGIKREYRTWSGFDYIILSELGTQKIPTHEVTYPKLYQGQKITIHSDGKNLEPHVKSNKNIRLKIDDFYIGVVNPFKLPEWRPESGAYVVTTYNHAEDLCLYFRTRSSSQSLYYGQLIMNDGRNKSLLNYTLKGSTYWIWSSAWYYENYNTSSKTAGNWYFIPVDEGWKED

SEQ ID NO: 112 - protein, 1274 aa, Artificial Sequence
  Synthetic polypeptide
MVTINDLHYSDPIDEDNIINMRIPLYDLEVDDQFINHNVPDLKAFQVFPNVWVVPERYTFYSTMKNLDAPANPSRSSYYDPTYLQSDAEKEVFLQQMILLFKRINSTQEGQQFLNLLSRSIPVPYESNGDVAMGTTQVIKQMDDKGNVLKHRRAHIIIYGPGPDLMAKGSKALTKSRETGRGCMAEIYFSPMYHKTYSTKLTNKNSLVDKSVQEFVPDPAVTLIHELCHGLHALYGIDLGNVGSWEFNSNPNSLFSSWFSSKEAVNFEEVMTFGGEDVKVIKSEIDKKIPGILNLIKTTVEPIINKITDPHDEMLQCLQSKYPSLKGTLGQFFFDDTQLEKDIRDLWMVMNETMFAENLKALTRARYLVPKVENIVQVDILSPNVYTIDKGFNHLSKGFKGQSVSQSYFRKISALARGAVVRACKSVKAPGICIEILEDDLFIMSSKDSFTDTDFSEPSVGPVSYKAKKGADTILDSTLSNYDFSKEINFTSTVPIITVEDPLETDEDVPVISEDRTVYVDDYTTFHFLEAQKIGKEVVPTQTKVVFTTNMEEALFDSKKVYTVFENTASRINEAGTGIANGMMFYQWLKGIVQDFTEEATQKDTFDKISDVTMIVPYLGNILNIGNDIRKGDFMGAVELGGVTILLEAIPELTLPVLIGLTIIEDELEKEQVSQTVYNVLDKRDEKWEEVYGFVKQQWWWMVHTQFETRILHAYQALNHQVEAIKANMTYQLANYRGNQEDKELLEKAIDDTLQSLYYAVDQAMHNIKRFLIQSSKSYLLNQMLPKTKEQLLAFDQQTLRNVNDFINKNQGVLGESLAKDLKKKVEKRLTSLPVFNLEDLPISEFEDLIHSHEIDIQDSEVLNIGVNNGKIQDLSGENTPLTLGENLHIVNGRDNQAVRLNNQLDSKLEIQSRPNIHFTAFEDFSISIWIRCSMLRNNRNRGQKYTIIQQFNKYGWQLAIQDSVFVWTLHDTFNNQIQLTSGSALTNKNYLLQNFWLHITVTNKRSEKSRLYINGVLQDQKDISVLGNCHPKEPILFSIQDNSDPNYFVRFEQFNVYRKALTDSEVNRLYWKYFEGSYLRDVWGERLTYNRDYYMQLSTLPGRGIKREYRTWSGFDYIILSELGTQKIPTHEVTYPKLYQGQKITIHSDGKNLEPHVKSNKNIRLKIDDFYIGVVNPFKLPEWRPESGAYVVTTYNHAEDLCLYFRTRSSSQSLYYGQLIMNDGRNKSLLNYTLKGSTYWIWSSAWYYENYNTSSKTAGNWYFIPVDEGWKED

SEQ ID NO: 113 - protein, 1281 aa, Artificial Sequence
  Synthetic polypeptide
MVTINDLHYSDPIDEDNIINMRIPLYDLEVDDQFINHNVPDLKAFQVFPNVWVVPERYTFYSTMKNLDAPANPSRSSYYDPTYLQSDAEKEVFLQQMILLFKRINSTQEGQQFLNLLSRSIPVPYESNGDVAMGTTQVIKQMDDKGNVLKHRRAHIIIYGPGPDLMAKGSKALTKSRETGRGCMAEIYFSPMYHKTYSTKLTNKNSLVDKSVQEFVPDPAVTLIHELCHGLHALYGIDLGNVGSWEFNSNPNSLFSSWFSSKEAVNFEEVMTFGGEDVKVIKSEIDKKIPGILNLIKTTVEPIINKITDPHDEMLQCLQSKYPSLKGTLGQFFFDDTQLEKDIRDLWMVMNETMFAENLKALTRARYLVPKVENIVQVDILSPNVYTIDKGFNHLSKGFKGQSVSQSYFRKISALARGAVVRACHKAIDGRSLYNKTLDCIEILEDDLFIMSSKDSFTDTDFSEPSVGPVSYKAKKGADTILDSTLSNYDFSKEINFTSTVPIITVEDPLETDEDVPVISEDRTVYVDDYTTFHFLEAQKIGKEVVPTQTKVVFTTNMEEALFDSKKVYTVFENTASRINEAGTGIANGMMFYQWLKGIVQDFTEEATQKDTFDKISDVTMIVPYLGNILNIGNDIRKGDFMGAVELGGVTILLEAIPELTLPVLIGLTIIEDELEKEQVSQTVYNVLDKRDEKWEEVYGFVKQQWWWMVHTQFETRILHAYQALNHQVEAIKANMTYQLANYRGNQEDKELLEKAIDDTLQSLYYAVDQAMHNIKRFLIQSSKSYLLNQMLPKTKEQLLAFDQQTLRNVNDFINKNQGVLGESLAKDLKKKVEKRLTSLPVFNLEDLPISEFEDLIHSHEIDIQDSEVLNIGVNNGKIQDLSGENTPLTLGENLHIVNGRDNQAVRLNNQLDSKLEIQSRPNIHFTAFEDFSISIWIRCSMLRNNRNRGQKYTIIQQFNKYGWQLAIQDSVFVWTLHDTFNNQIQLTSGSALTNKNYLLQNFWLHITVTNKRSEKSRLYINGVLQDQKDISVLGNCHPKEPILFSIQDNSDPNYFVRFEQFNVYRKALTDSEVNRLYWKYFEGSYLRDVWGERLTYNRDYYMQLSTLPGRGIKREYRTWSGFDYIILSELGTQKIPTHEVTYPKLYQGQKITIHSDGKNLEPHVKSNKNIRLKIDDFYIGVVNPFKLPEWRPESGAYVVTTYNHAEDLCLYFRTRSSSQSLYYGQLIMNDGRNKSLLNYTLKGSTYWIWSSAWYYENYNTSSKTAGNWYFIPVDEGWKED

SEQ ID NO: 114 - protein, 1278 aa, Artificial Sequence
  Synthetic polypeptide
MVTINDLHYSDPIDEDNIINMRIPLYDLEVDDQFINHNVPDLKAFQVFPNVWVVPERYTFYSTMKNLDAPANPSRSSYYDPTYLQSDAEKEVFLQQMILLFKRINSTQEGQQFLNLLSRSIPVPYESNGDVAMGTTQVIKQMDDKGNVLKHRRAHIIIYGPGPDLMAKGSKALTKSRETGRGCMAEIYFSPMYHKTYSTKLTNKNSLVDKSVQEFVPDPAVTLIHELCHGLHALYGIDLGNVGSWEFNSNPNSLFSSWFSSKEAVNFEEVMTFGGEDVKVIKSEIDKKIPGILNLIKTTVEPIINKITDPHDEMLQCLQSKYPSLKGTLGQFFFDDTQLEKDIRDLWMVMNETMFAENLKALTRARYLVPKVENIVQVDILSPNVYTIDKGFNHLSKGFKGQSVSQSYFRKISALARGAVVRACLRLTKNSRDDSTCIEILEDDLFIMSSKDSFTDTDFSEPSVGPVSYKAKKGADTILDSTLSNYDFSKEINFTSTVPIITVEDPLETDEDVPVISEDRTVYVDDYTTFHFLEAQKIGKEVVPTQTKVVFTTNMEEALFDSKKVYTVFENTASRINEAGTGIANGMMFYQWLKGIVQDFTEEATQKDTFDKISDVTMIVPYLGNILNIGNDIRKGDFMGAVELGGVTILLEAIPELTLPVLIGLTIIEDELEKEQVSQTVYNVLDKRDEKWEEVYGFVKQQWWWMVHTQFETRILHAYQALNHQVEAIKANMTYQLANYRGNQEDKELLEKAIDDTLQSLYYAVDQAMHNIKRFLIQSSKSYLLNQMLPKTKEQLLAFDQQTLRNVNDFINKNQGVLGESLAKDLKKKVEKRLTSLPVFNLEDLPISEFEDLIHSHEIDIQDSEVLNIGVNNGKIQDLSGENTPLTLGENLHIVNGRDNQAVRLNNQLDSKLEIQSRPNIHFTAFEDFSISIWIRCSMLRNNRNRGQKYTIIQQFNKYGWQLAIQDSVFVWTLHDTFNNQIQLTSGSALTNKNYLLQNFWLHITVTNKRSEKSRLYINGVLQDQKDISVLGNCHPKEPILFSIQDNSDPNYFVRFEQFNVYRKALTDSEVNRLYWKYFEGSYLRDVWGERLTYNRDYYMQLSTLPGRGIKREYRTWSGFDYIILSELGTQKIPTHEVTYPKLYQGQKITIHSDGKNLEPHVKSNKNIRLKIDDFYIGVVNPFKLPEWRPESGAYVVTTYNHAEDLCLYFRTRSSSQSLYYGQLIMNDGRNKSLLNYTLKGSTYWIWSSAWYYENYNTSSKTAGNWYFIPVDEGWKED

SEQ ID NO: 115 - protein, 1279 aa, Artificial Sequence
  Synthetic polypeptide
MVTINDLHYSDPIDEDNIINMRIPLYDLEVDDQFINHNVPDLKAFQVFPNVWVVPERYTFYSTMKNLDAPANPSRSSYYDPTYLQSDAEKEVFLQQMILLFKRINSTQEGQQFLNLLSRSIPVPYESNGDVAMGTTQVIKQMDDKGNVLKHRRAHIIIYGPGPDLMAKGSKALTKSRETGRGCMAEIYFSPMYHKTYSTKLTNKNSLVDKSVQEFVPDPAVTLIHELCHGLHALYGIDLGNVGSWEFNSNPNSLFSSWFSSKEAVNFEEVMTFGGEDVKVIKSEIDKKIPGILNLIKTTVEPIINKITDPHDEMLQCLQSKYPSLKGTLGQFFFDDTQLEKDIRDLWMVMNETMFAENLKALTRARYLVPKVENIVQVDILSPNVYTIDKGFNHLSKGFKGQSVSQSYFRKISALARGAVVRACKNIVSVKGIRKSICIEILEDDLFIMSSKDSFTDTDFSEPSVGPVSYKAKKGADTILDSTLSNYDFSKEINFTSTVPIITVEDPLETDEDVPVISEDRTVYVDDYTTFHFLEAQKIGKEVVPTQTKVVFTTNMEEALFDSKKVYTVFENTASRINEAGTGIANGMMFYQWLKGIVQDFTEEATQKDTFDKISDVTMIVPYLGNILNIGNDIRKGDFMGAVELGGVTILLEAIPELTLPVLIGLTIIEDELEKEQVSQTVYNVLDKRDEKWEEVYGFVKQQWWWMVHTQFETRILHAYQALNHQVEAIKANMTYQLANYRGNQEDKELLEKAIDDTLQSLYYAVDQAMHNIKRFLIQSSKSYLLNQMLPKTKEQLLAFDQQTLRNVNDFINKNQGVLGESLAKDLKKKVEKRLTSLPVFNLEDLPISEFEDLIHSHEIDIQDSEVLNIGVNNGKIQDLSGENTPLTLGENLHIVNGRDNQAVRLNNQLDSKLEIQSRPNIHFTAFEDFSISIWIRCSMLRNNRNRGQKYTIIQQFNKYGWQLAIQDSVFVWTLHDTFNNQIQLTSGSALTNKNYLLQNFWLHITVTNKRSEKSRLYINGVLQDQKDISVLGNCHPKEPILFSIQDNSDPNYFVRFEQFNVYRKALTDSEVNRLYWKYFEGSYLRDVWGERLTYNRDYYMQLSTLPGRGIKREYRTWSGFDYIILSELGTQKIPTHEVTYPKLYQGQKITIHSDGKNLEPHVKSNKNIRLKIDDFYIGVVNPFKLPEWRPESGAYVVTTYNHAEDLCLYFRTRSSSQSLYYGQLIMNDGRNKSLLNYTLKGSTYWIWSSAWYYENYNTSSKTAGNWYFIPVDEGWKED

SEQ ID NO: 116 - protein, 1281 aa, Artificial Sequence
  Synthetic polypeptide
MVTINDLHYSDPIDEDNIINMRIPLYDLEVDDQFINHNVPDLKAFQVFPNVWVVPERYTFYSTMKNLDAPANPSRSSYYDPTYLQSDAEKEVFLQQMILLFKRINSTQEGQQFLNLLSRSIPVPYESNGDVAMGTTQVIKQMDDKGNVLKHRRAHIIIYGPGPDLMAKGSKALTKSRETGRGCMAEIYFSPMYHKTYSTKLTNKNSLVDKSVQEFVPDPAVTLIHELCHGLHALYGIDLGNVGSWEFNSNPNSLFSSWFSSKEAVNFEEVMTFGGEDVKVIKSEIDKKIPGILNLIKTTVEPIINKITDPHDEMLQCLQSKYPSLKGTLGQFFFDDTQLEKDIRDLWMVMNETMFAENLKALTRARYLVPKVENIVQVDILSPNVYTIDKGFNHLSKGFKGQSVSQSYFRKISALARGAVVRACKSVIPRKGTKAPPRLCIEILEDDLFIMSSKDSFTDTDFSEPSVGPVSYKAKKGADTILDSTLSNYDFSKEINFTSTVPIITVEDPLETDEDVPVISEDRTVYVDDYTTFHFLEAQKIGKEVVPTQTKVVFTTNMEEALFDSKKVYTVFENTASRINEAGTGIANGMMFYQWLKGIVQDFTEEATQKDTFDKISDVTMIVPYLGNILNIGNDIRKGDFMGAVELGGVTILLEAIPELTLPVLIGLTIIEDELEKEQVSQTVYNVLDKRDEKWEEVYGFVKQQWWWMVHTQFETRILHAYQALNHQVEAIKANMTYQLANYRGNQEDKELLEKAIDDTLQSLYYAVDQAMHNIKRFLIQSSKSYLLNQMLPKTKEQLLAFDQQTLRNVNDFINKNQGVLGESLAKDLKKKVEKRLTSLPVFNLEDLPISEFEDLIHSHEIDIQDSEVLNIGVNNGKIQDLSGENTPLTLGENLHIVNGRDNQAVRLNNQLDSKLEIQSRPNIHFTAFEDFSISIWIRCSMLRNNRNRGQKYTIIQQFNKYGWQLAIQDSVFVWTLHDTFNNQIQLTSGSALTNKNYLLQNFWLHITVTNKRSEKSRLYINGVLQDQKDISVLGNCHPKEPILFSIQDNSDPNYFVRFEQFNVYRKALTDSEVNRLYWKYFEGSYLRDVWGERLTYNRDYYMQLSTLPGRGIKREYRTWSGFDYIILSELGTQKIPTHEVTYPKLYQGQKITIHSDGKNLEPHVKSNKNIRLKIDDFYIGVVNPFKLPEWRPESGAYVVTTYNHAEDLCLYFRTRSSSQSLYYGQLIMNDGRNKSLLNYTLKGSTYWIWSSAWYYENYNTSSKTAGNWYFIPVDEGWKED

SEQ ID NO: 117 - protein, 1279 aa, Artificial Sequence
  Synthetic polypeptide
MVTINDLHYSDPIDEDNIINMRIPLYDLEVDDQFINHNVPDLKAFQVFPNVWVVPERYTFYSTMKNLDAPANPSRSSYYDPTYLQSDAEKEVFLQQMILLFKRINSTQEGQQFLNLLSRSIPVPYESNGDVAMGTTQVIKQMDDKGNVLKHRRAHIIIYGPGPDLMAKGSKALTKSRETGRGCMAEIYFSPMYHKTYSTKLTNKNSLVDKSVQEFVPDPAVTLIHELCHGLHALYGIDLGNVGSWEFNSNPNSLFSSWFSSKEAVNFEEVMTFGGEDVKVIKSEIDKKIPGILNLIKTTVEPIINKITDPHDEMLQCLQSKYPSLKGTLGQFFFDDTQLEKDIRDLWMVMNETMFAENLKALTRARYLVPKVENIVQVDILSPNVYTIDKGFNHLSKGFKGQSVSQSYFRKISALARGAVVRACKPVMYKNTGKSEQCIEILEDDLFIMSSKDSFTDTDFSEPSVGPVSYKAKKGADTILDSTLSNYDFSKEINFTSTVPIITVEDPLETDEDVPVISEDRTVYVDDYTTFHFLEAQKIGKEVVPTQTKVVFTTNMEEALFDSKKVYTVFENTASRINEAGTGIANGMMFYQWLKGIVQDFTEEATQKDTFDKISDVTMIVPYLGNILNIGNDIRKGDFMGAVELGGVTILLEAIPELTLPVLIGLTIIEDELEKEQVSQTVYNVLDKRDEKWEEVYGFVKQQWWWMVHTQFETRILHAYQALNHQVEAIKANMTYQLANYRGNQEDKELLEKAIDDTLQSLYYAVDQAMHNIKRFLIQSSKSYLLNQMLPKTKEQLLAFDQQTLRNVNDFINKNQGVLGESLAKDLKKKVEKRLTSLPVFNLEDLPISEFEDLIHSHEIDIQDSEVLNIGVNNGKIQDLSGENTPLTLGENLHIVNGRDNQAVRLNNQLDSKLEIQSRPNIHFTAFEDFSISIWIRCSMLRNNRNRGQKYTIIQQFNKYGWQLAIQDSVFVWTLHDTFNNQIQLTSGSALTNKNYLLQNFWLHITVTNKRSEKSRLYINGVLQDQKDISVLGNCHPKEPILFSIQDNSDPNYFVRFEQFNVYRKALTDSEVNRLYWKYFEGSYLRDVWGERLTYNRDYYMQLSTLPGRGIKREYRTWSGFDYIILSELGTQKIPTHEVTYPKLYQGQKITIHSDGKNLEPHVKSNKNIRLKIDDFYIGVVNPFKLPEWRPESGAYVVTTYNHAEDLCLYFRTRSSSQSLYYGQLIMNDGRNKSLLNYTLKGSTYWIWSSAWYYENYNTSSKTAGNWYFIPVDEGWKED

SEQ ID NO: 118 - protein, 1309 aa, Artificial Sequence
  Synthetic polypeptide
MVTINDLHYSDPIDEDNIINMRIPLYDLEVDDQFINHNVPDLKAFQVFPNVWVVPERYTFYSTMKNLDAPANPSRSSYYDPTYLQSDAEKEVFLQQMILLFKRINSTQEGQQFLNLLSRSIPVPYESNGDVAMGTTQVIKQMDDKGNVLKHRRAHIIIYGPGPDLMAKGSKALTKSRETGRGCMAEIYFSPMYHKTYSTKLTNKNSLVDKSVQEFVPDPAVTLIHELCHGLHALYGIDLGNVGSWEFNSNPNSLFSSWFSSKEAVNFEEVMTFGGEDVKVIKSEIDKKIPGILNLIKTTVEPIINKITDPHDEMLQCLQSKYPSLKGTLGQFFFDDTQLEKDIRDLWMVMNETMFAENLKALTRARYLVPKVENIVQVDILSPNVYTIDKGFNHLSKGFKGQSVSQSYFRKISALARGAVVRACPRNGLLYNAIYRNSKNYLNNIDLEDKKTTSKTNVSYPCSLLNGCIEILEDDLFIMSSKDSFTDTDFSEPSVGPVSYKAKKGADTILDSTLSNYDFSKEINFTSTVPIITVEDPLETDEDVPVISEDRTVYVDDYTTFHFLEAQKIGKEVVPTQTKVVFTTNMEEALFDSKKVYTVFENTASRINEAGTGIANGMMFYQWLKGIVQDFTEEATQKDTFDKISDVTMIVPYLGNILNIGNDIRKGDFMGAVELGGVTILLEAIPELTLPVLIGLTIIEDELEKEQVSQTVYNVLDKRDEKWEEVYGFVKQQWWWMVHTQFETRILHAYQALNHQVEAIKANMTYQLANYRGNQEDKELLEKAIDDTLQSLYYAVDQAMHNIKRFLIQSSKSYLLNQMLPKTKEQLLAFDQQTLRNVNDFINKNQGVLGESLAKDLKKKVEKRLTSLPVFNLEDLPISEFEDLIHSHEIDIQDSEVLNIGVNNGKIQDLSGENTPLTLGENLHIVNGRDNQAVRLNNQLDSKLEIQSRPNIHFTAFEDFSISIWIRCSMLRNNRNRGQKYTIIQQFNKYGWQLAIQDSVFVWTLHDTFNNQIQLTSGSALTNKNYLLQNFWLHITVTNKRSEKSRLYINGVLQDQKDISVLGNCHPKEPILFSIQDNSDPNYFVRFEQFNVYRKALTDSEVNRLYWKYFEGSYLRDVWGERLTYNRDYYMQLSTLPGRGIKREYRTWSGFDYIILSELGTQKIPTHEVTYPKLYQGQKITIHSDGKNLEPHVKSNKNIRLKIDDFYIGVVNPFKLPEWRPESGAYVVTTYNHAEDLCLYFRTRSSSQSLYYGQLIMNDGRNKSLLNYTLKGSTYWIWSSAWYYENYNTSSKTAGNWYFIPVDEGWKED

SEQ ID NO: 119 - protein, 1286 aa, Artificial Sequence
  Synthetic polypeptide
MVTINDLHYSDPIDEDNIINMRIPLYDLEVDDQFINHNVPDLKAFQVFPNVWVVPERYTFYSTMKNLDAPANPSRSSYYDPTYLQSDAEKEVFLQQMILLFKRINSTQEGQQFLNLLSRSIPVPYESNGDVAMGTTQVIKQMDDKGNVLKHRRAHIIIYGPGPDLMAKGSKALTKSRETGRGCMAEIYFSPMYHKTYSTKLTNKNSLVDKSVQEFVPDPAVTLIHELCHGLHALYGIDLGNVGSWEFNSNPNSLFSSWFSSKEAVNFEEVMTFGGEDVKVIKSEIDKKIPGILNLIKTTVEPIINKITDPHDEMLQCLQSKYPSLKGTLGQFFFDDTQLEKDIRDLWMVMNETMFAENLKALTRARYLVPKVENIVQVDILSPNVYTIDKGFNHLSKGFKGQSVSQSYFRKISALARGAVVRACPNPHFSSQRGLSSCIEILEDDLFIMSSKDSFTDTDFSEPSVGPVSYKAKKGADTILDSTLSNYDFSKEINFTSTVPIITVEDPLETDEDVPVISEDRTVYVDDYTTFHFLEAQKIGKEVVPTQTKVVFTTNMEEALFDSKKVYTVFENTASRINEAGTGIANGMMFYQWLKGIVQDFTEEATQKDTFDKISDVTMIVPYLGNILNIGNDIRKGDFMGAVELGGVTILLEAIPELTLPVLIGLTIIEDELEKEQVSQTVYNVLDKRDEKWEEVYGFVKQQWWWMVHTQFETRILHAYQALNHQVEAIKANMTYQLANYRGNQEDKELLEKAIDDTLQSLYYAVDQAMHNIKRFLIQSSKSYLLNQMLPKTKEQLLAFDQQTLRNVNDFINKNQGVLGESLAKDLKKKVEKRLTSLPVFNLEDLPISEFEDLIHSHEIDIIINTSILNLRYESNHLIDLSRYASKINIGSKVNFDPIDKNQIQLFNLESSKIEVILKNAIVYNSMYENFSTSFWIRIPKYFNSISLNNEYTIINCMENNSGWKVSLNYGEIIWTLQDTQEIKQRVVFKYSQMINISDYINRWIFVTITNNRLNNSKIYINGRLIDQKPISNLGNIHASNNIMFKLDGCRDTHRYIWIKYFNLFDKELNEKEIKDLYDNQSNSGILKDFWGDYLQYDKPYYMLNLYDPNKYVDVNNVGIRGYMYLKGPRGSVMTTNIYLNSSLYRGTKFIIKKYASGNKDNIVRNNDRVYINVVVKNKEYRLATNASQAGVEKILSALEIPDVGNLSQVVVMKSKNDQGITNKCKMNLQDNNGNDIGFIGFHQFNNIAKLVASNWYNRQIERSSRTLGCSWEFIPVDDGWGERPL

SEQ ID NO: 120 - protein, 1294 aa, Artificial Sequence
  Synthetic polypeptide
MVTINDLHYSDPIDEDNIINMRIPLYDLEVDDQFINHNVPDLKAFQVFPNVWVVPERYTFYSTMKNLDAPANPSRSSYYDPTYLQSDAEKEVFLQQMILLFKRINSTQEGQQFLNLLSRSIPVPYESNGDVAMGTTQVIKQMDDKGNVLKHRRAHIIIYGPGPDLMAKGSKALTKSRETGRGCMAEIYFSPMYHKTYSTKLTNKNSLVDKSVQEFVPDPAVTLIHELCHGLHALYGIDLGNVGSWEFNSNPNSLFSSWFSSKEAVNFEEVMTFGGEDVKVIKSEIDKKIPGILNLIKTTVEPIINKITDPHDEMLQCLQSKYPSLKGTLGQFFFDDTQLEKDIRDLWMVMNETMFAENLKALTRARYLVPKVENIVQVDILSPNVYTIDKGFNHLSKGFKGQSVSQSYFRKISALARGAVVRACPNPHFSSQRGLSSCIEILEDDLFIMSSKDSFTDTDFSEPSVGPVSYKAKKGADTILDSTLSNYDFSKEINFTSTVPIITVEDPLETDEDVPVISEDRTVYVDDYTTFHFLEAQKIGKEVVPTQTKVVFTTNMEEALFDSKKVYTVFENTASRINEAGTGIANGMMFYQWLKGIVQDFTEEATQKDTFDKISDVTMIVPYLGNILNIGNDIRKGDFMGAVELGGVTILLEAIPELTLPVLIGLTIIEDELEKEQVSQTVYNVLDKRDEKWEEVYGFVKQQWWWMVHTQFETRILHAYQALNHQVEAIKANMTYQLANYRGNQEDKELLEKAIDDTLQSLYYAVDQAMHNIKRFLIQSSKSYLLNQMLPKTKEQLLAFDQQTLRNVNDFINKNQGVLGESLAKDLKKKVEKRLTSLPVFNLEDLPISEFEDLIHSHEIDIILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEEKLFLAPISDSDEFYNTIQIKEYDEQPTYSCQLLFKKDEESTDEIGLIGIHRFYESGIVFEEYKDYFCISKWYLKEVKRKPYNLKLGCNWQFIPKDEGWTE

SEQ ID NO: 121 - protein, 1286 aa, Artificial Sequence
  Synthetic polypeptide
MVTINDLHYSDPIDEDNIINMRIPLYDLEVDDQFINHNVPDLKAFQVFPNVWVVPERYTFYSTMKNLDAPANPSRSSYYDPTYLQSDAEKEVFLQQMILLFKRINSTQEGQQFLNLLSRSIPVPYESNGDVAMGTTQVIKQMDDKGNVLKHRRAHIIIYGPGPDLMAKGSKALTKSRETGRGCMAEIYFSPMYHKTYSTKLTNKNSLVDKSVQEFVPDPAVTLIHELCHGLHALYGIDLGNVGSWEFNSNPNSLFSSWFSSKEAVNFEEVMTFGGEDVKVIKSEIDKKIPGILNLIKTTVEPIINKITDPHDEMLQCLQSKYPSLKGTLGQFFFDDTQLEKDIRDLWMVMNETMFAENLKALTRARYLVPKVENIVQVDILSPNVYTIDKGFNHLSKGFKGQSVSQSYFRKISALARGAVVRACPNPHFSSQRGLSSCIEILEDDLFIMSSKDSFTDTDFSEPSVGPVSYKAKKGADTILDSTLSNYDFSKEINFTSTVPIITVEDPLETDEDVPVISEDRTVYVDDYTTFHFLEAQKIGKEVVPTQTKVVFTTNMEEALFDSKKVYTVFENTASRINEAGTGIANGMMFYQWLKGIVQDFTEEATQKDTFDKISDVTMIVPYLGNILNIGNDIRKGDFMGAVELGGVTILLEAIPELTLPVLIGLTIIEDELEKEQVSQTVYNVLDKRDEKWEEVYGFVKQQWWWMVHTQFETRILHAYQALNHQVEAIKANMTYQLANYRGNQEDKELLEKAIDDTLQSLYYAVDQAMHNIKRFLIQSSKSYLLNQMLPKTKEQLLAFDQQTLRNVNDFINKNQGVLGESLAKDLKKKVEKRLTSLPVFNLEDLPISEFEDLIHSHEIDIINDSKILSLQNRKNTLVDTSGYNAEVSEEGDVQLNPIFPFDFKLGSSGEDRGKVIVTQNENIVYNSMYESFSISFWIRINKWVSNLPGYTIIDSVKNNSGWSIGIISNFLVFTLKQNEDSEQSINFSYDISNNAPGYNKWFFVTVTNNMMGNMKIYINGKLIDTIKVKELTGINFSKTITFEINKIPDTGLITSDSDNINMWIRDFYIFAKELDGKDINILFNSLQYTNVVKDYWGNDLRYNKEYYMVNIDYLNRYMYANSRQIVFNTRRNNNDFNEGYKIIIKRIRGNTNDTRVRGGDILYFDMTINNKAYNLFMKNETMYADNHSTEDIYAIGLREQTKDINDNIIFQIQPMNNTYYYASQIFKSNFNGENISGICSIGTYRFRLGGDWYRHNYLVPTVKQGNYASLLESTSTHWGFVPVSE

SEQ ID NO: 122 - protein, 1276 aa, Artificial Sequence
  Synthetic polypeptide
MVTINDLHYSDPIDEDNIINMRIPLYDLEVDDQFINHNVPDLKAFQVFPNVWVVPERYTFYSTMKNLDAPANPSRSSYYDPTYLQSDAEKEVFLQQMILLFKRINSTQEGQQFLNLLSRSIPVPYESNGDVAMGTTQVIKQMDDKGNVLKHRRAHIIIYGPGPDLMAKGSKALTKSRETGRGCMAEIYFSPMYHKTYSTKLTNKNSLVDKSVQEFVPDPAVTLIHELCHGLHALYGIDLGNVGSWEFNSNPNSLFSSWFSSKEAVNFEEVMTFGGEDVKVIKSEIDKKIPGILNLIKTTVEPIINKITDPHDEMLQCLQSKYPSLKGTLGQFFFDDTQLEKDIRDLWMVMNETMFAENLKALTRARYLVPKVENIVQVDILSPNVYTIDKGFNHLSKGFKGQSVSQSYFRKISALARGAVVRACPNPHFSSQRGLSSCIEILEDDLFIMSSKDSFTDTDFSEPSVGPVSYKAKKGADTILDSTLSNYDFSKEINFTSTVPIITVEDPLETDEDVPVISEDRTVYVDDYTTFHFLEAQKIGKEVVPTQTKVVFTTNMEEALFDSKKVYTVFENTASRINEAGTGIANGMMFYQWLKGIVQDFTEEATQKDTFDKISDVTMIVPYLGNILNIGNDIRKGDFMGAVELGGVTILLEAIPELTLPVLIGLTIIEDELEKEQVSQTVYNVLDKRDEKWEEVYGFVKQQWWWMVHTQFETRILHAYQALNHQVEAIKANMTYQLANYRGNQEDKELLEKAIDDTLQSLYYAVDQAMHNIKRFLIQSSKSYLLNQMLPKTKEQLLAFDQQTLRNVNDFINKNQGVLGESLAKDLKKKVEKRLTSLPVFNLEDLPISEFEDLIHSHEIDIEDYEVLNLGAEDGKIKDLSGTTSDINIGSDIELADGRENKAIKIKGSENSTIKIAMNKYLRFSATDNFSISFWIKHPKPTNLLNNGIEYTLVENFNQRGWKISIQDSKLIWYLRDHNNSIKIVTPDYIAFNGWNLITITNNRSKGSIVYVNGSKIEEKDISSIWNTEVDDPIIFRLKNNRDTQAFTLLDQFSIYRKELNQNEVVKLYNYYFNSNYIRDIWGNPLQYNKKYYLQTQDKPGKGLIREYWSSFGYDYVILSDSKTITFPNNIRYGALYNGSKVLIKNSKKLDGLVRNKDFIQLEIDGYNMGISADRFNEDTNYIGTTYGTTHDLTTDFEIIQRQEKYRNYCQLKTPYNIFHKSGLMSTETSKPTFHDYRDWVYSSAWYFQNYENLNLRKHTKTNWYFIPKDEGWDED

SEQ ID NO: 123 - protein, 1290 aa, Artificial Sequence
  Synthetic polypeptide
MVTINDLHYSDPIDEDNIINMRIPLYDLEVDDQFINHNVPDLKAFQVFPNVWVVPERYTFYSTMKNLDAPANPSRSSYYDPTYLQSDAEKEVFLQQMILLFKRINSTQEGQQFLNLLSRSIPVPYESNGDVAMGTTQVIKQMDDKGNVLKHRRAHIIIYGPGPDLMAKGSKALTKSRETGRGCMAEIYFSPMYHKTYSTKLTNKNSLVDKSVQEFVPDPAVTLIHELCHGLHALYGIDLGNVGSWEFNSNPNSLFSSWFSSKEAVNFEEVMTFGGEDVKVIKSEIDKKIPGILNLIKTTVEPIINKITDPHDEMLQCLQSKYPSLKGTLGQFFFDDTQLEKDIRDLWMVMNETMFAENLKALTRARYLVPKVENIVQVDILSPNVYTIDKGFNHLSKGFKGQSVSQSYFRKISALARGAVVRACPNPHFSSQLVPRGSLSSCIEILEDDLFIMSSKDSFTDTDFSEPSVGPVSYKAKKGADTILDSTLSNYDFSKEINFTSTVPIITVEDPLETDEDVPVISEDRTVYVDDYTTFHFLEAQKIGKEVVPTQTKVVFTTNMEEALFDSKKVYTVFENTASRINEAGTGIANGMMFYQWLKGIVQDFTEEATQKDTFDKISDVTMIVPYLGNILNIGNDIRKGDFMGAVELGGVTILLEAIPELTLPVLIGLTIIEDELEKEQVSQTVYNVLDKRDEKWEEVYGFVKQQWWWMVHTQFETRILHAYQALNHQVEAIKANMTYQLANYRGNQEDKELLEKAIDDTLQSLYYAVDQAMHNIKRFLIQSSKSYLLNQMLPKTKEQLLAFDQQTLRNVNDFINKNQGVLGESLAKDLKKKVEKRLTSLPVFNLEDLPISEFEDLIHSHEIDIIINTSILNLRYESNHLIDLSRYASKINIGSKVNFDPIDKNQIQLFNLESSKIEVILKNAIVYNSMYENFSTSFWIRIPKYFNSISLNNEYTIINCMENNSGWKVSLNYGEIIWTLQDTQEIKQRVVFKYSQMINISDYINRWIFVTITNNRLNNSKIYINGRLIDQKPISNLGNIHASNNIMFKLDGCRDTHRYIWIKYFNLFDKELNEKEIKDLYDNQSNSGILKDFWGDYLQYDKPYYMLNLYDPNKYVDVNNVGIRGYMYLKGPRGSVMTTNIYLNSSLYRGTKFIIKKYASGNKDNIVRNNDRVYINVVVKNKEYRLATNASQAGVEKILSALEIPDVGNLSQVVVMKSKNDQGITNKCKMNLQDNNGNDIGFIGFHQFNNIAKLVASNWYNRQIERSSRTLGCSWEFIPVDDGWGERPL

SEQ ID NO: 124 - protein, 1298 aa, Artificial Sequence
  Synthetic polypeptide
MVTINDLHYSDPIDEDNIINMRIPLYDLEVDDQFINHNVPDLKAFQVFPNVWVVPERYTFYSTMKNLDAPANPSRSSYYDPTYLQSDAEKEVFLQQMILLFKRINSTQEGQQFLNLLSRSIPVPYESNGDVAMGTTQVIKQMDDKGNVLKHRRAHIIIYGPGPDLMAKGSKALTKSRETGRGCMAEIYFSPMYHKTYSTKLTNKNSLVDKSVQEFVPDPAVTLIHELCHGLHALYGIDLGNVGSWEFNSNPNSLFSSWFSSKEAVNFEEVMTFGGEDVKVIKSEIDKKIPGILNLIKTTVEPIINKITDPHDEMLQCLQSKYPSLKGTLGQFFFDDTQLEKDIRDLWMVMNETMFAENLKALTRARYLVPKVENIVQVDILSPNVYTIDKGFNHLSKGFKGQSVSQSYFRKISALARGAVVRACPNPHFSSQLVPRGSLSSCIEILEDDLFIMSSKDSFTDTDFSEPSVGPVSYKAKKGADTILDSTLSNYDFSKEINFTSTVPIITVEDPLETDEDVPVISEDRTVYVDDYTTFHFLEAQKIGKEVVPTQTKVVFTTNMEEALFDSKKVYTVFENTASRINEAGTGIANGMMFYQWLKGIVQDFTEEATQKDTFDKISDVTMIVPYLGNILNIGNDIRKGDFMGAVELGGVTILLEAIPELTLPVLIGLTIIEDELEKEQVSQTVYNVLDKRDEKWEEVYGFVKQQWWWMVHTQFETRILHAYQALNHQVEAIKANMTYQLANYRGNQEDKELLEKAIDDTLQSLYYAVDQAMHNIKRFLIQSSKSYLLNQMLPKTKEQLLAFDQQTLRNVNDFINKNQGVLGESLAKDLKKKVEKRLTSLPVFNLEDLPISEFEDLIHSHEIDIILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEEKLFLAPISDSDEFYNTIQIKEYDEQPTYSCQLLFKKDEESTDEIGLIGIHRFYESGIVFEEYKDYFCISKWYLKEVKRKPYNLKLGCNWQFIPKDEGWTE

SEQ ID NO: 125 - protein, 1290 aa, Artificial Sequence
  Synthetic polypeptide
MVTINDLHYSDPIDEDNIINMRIPLYDLEVDDQFINHNVPDLKAFQVFPNVWVVPERYTFYSTMKNLDAPANPSRSSYYDPTYLQSDAEKEVFLQQMILLFKRINSTQEGQQFLNLLSRSIPVPYESNGDVAMGTTQVIKQMDDKGNVLKHRRAHIIIYGPGPDLMAKGSKALTKSRETGRGCMAEIYFSPMYHKTYSTKLTNKNSLVDKSVQEFVPDPAVTLIHELCHGLHALYGIDLGNVGSWEFNSNPNSLFSSWFSSKEAVNFEEVMTFGGEDVKVIKSEIDKKIPGILNLIKTTVEPIINKITDPHDEMLQCLQSKYPSLKGTLGQFFFDDTQLEKDIRDLWMVMNETMFAENLKALTRARYLVPKVENIVQVDILSPNVYTIDKGFNHLSKGFKGQSVSQSYFRKISALARGAVVRACPNPHFSSQLVPRGSLSSCIEILEDDLFIMSSKDSFTDTDFSEPSVGPVSYKAKKGADTILDSTLSNYDFSKEINFTSTVPIITVEDPLETDEDVPVISEDRTVYVDDYTTFHFLEAQKIGKEVVPTQTKVVFTTNMEEALFDSKKVYTVFENTASRINEAGTGIANGMMFYQWLKGIVQDFTEEATQKDTFDKISDVTMIVPYLGNILNIGNDIRKGDFMGAVELGGVTILLEAIPELTLPVLIGLTIIEDELEKEQVSQTVYNVLDKRDEKWEEVYGFVKQQWWWMVHTQFETRILHAYQALNHQVEAIKANMTYQLANYRGNQEDKELLEKAIDDTLQSLYYAVDQAMHNIKRFLIQSSKSYLLNQMLPKTKEQLLAFDQQTLRNVNDFINKNQGVLGESLAKDLKKKVEKRLTSLPVFNLEDLPISEFEDLIHSHEIDIINDSKILSLQNRKNTLVDTSGYNAEVSEEGDVQLNPIFPFDFKLGSSGEDRGKVIVTQNENIVYNSMYESFSISFWIRINKWVSNLPGYTIIDSVKNNSGWSIGIISNFLVFTLKQNEDSEQSINFSYDISNNAPGYNKWFFVTVTNNMMGNMKIYINGKLIDTIKVKELTGINFSKTITFEINKIPDTGLITSDSDNINMWIRDFYIFAKELDGKDINILFNSLQYTNVVKDYWGNDLRYNKEYYMVNIDYLNRYMYANSRQIVFNTRRNNNDFNEGYKIIIKRIRGNTNDTRVRGGDILYFDMTINNKAYNLFMKNETMYADNHSTEDIYAIGLREQTKDINDNIIFQIQPMNNTYYYASQIFKSNFNGENISGICSIGTYRFRLGGDWYRHNYLVPTVKQGNYASLLESTSTHWGFVPVSE

SEQ ID NO: 126 - protein, 1280 aa, Artificial Sequence
  Synthetic polypeptide
MVTINDLHYSDPIDEDNIINMRIPLYDLEVDDQFINHNVPDLKAFQVFPNVWVVPERYTFYSTMKNLDAPANPSRSSYYDPTYLQSDAEKEVFLQQMILLFKRINSTQEGQQFLNLLSRSIPVPYESNGDVAMGTTQVIKQMDDKGNVLKHRRAHIIIYGPGPDLMAKGSKALTKSRETGRGCMAEIYFSPMYHKTYSTKLTNKNSLVDKSVQEFVPDPAVTLIHELCHGLHALYGIDLGNVGSWEFNSNPNSLFSSWFSSKEAVNFEEVMTFGGEDVKVIKSEIDKKIPGILNLIKTTVEPIINKITDPHDEMLQCLQSKYPSLKGTLGQFFFDDTQLEKDIRDLWMVMNETMFAENLKALTRARYLVPKVENIVQVDILSPNVYTIDKGFNHLSKGFKGQSVSQSYFRKISALARGAVVRACPNPHFSSQLVPRGSLSSCIEILEDDLFIMSSKDSFTDTDFSEPSVGPVSYKAKKGADTILDSTLSNYDFSKEINFTSTVPIITVEDPLETDEDVPVISEDRTVYVDDYTTFHFLEAQKIGKEVVPTQTKVVFTTNMEEALFDSKKVYTVFENTASRINEAGTGIANGMMFYQWLKGIVQDFTEEATQKDTFDKISDVTMIVPYLGNILNIGNDIRKGDFMGAVELGGVTILLEAIPELTLPVLIGLTIIEDELEKEQVSQTVYNVLDKRDEKWEEVYGFVKQQWWWMVHTQFETRILHAYQALNHQVEAIKANMTYQLANYRGNQEDKELLEKAIDDTLQSLYYAVDQAMHNIKRFLIQSSKSYLLNQMLPKTKEQLLAFDQQTLRNVNDFINKNQGVLGESLAKDLKKKVEKRLTSLPVFNLEDLPISEFEDLIHSHEIDIEDYEVLNLGAEDGKIKDLSGTTSDINIGSDIELADGRENKAIKIKGSENSTIKIAMNKYLRFSATDNFSISFWIKHPKPTNLLNNGIEYTLVENFNQRGWKISIQDSKLIWYLRDHNNSIKIVTPDYIAFNGWNLITITNNRSKGSIVYVNGSKIEEKDISSIWNTEVDDPIIFRLKNNRDTQAFTLLDQFSIYRKELNQNEVVKLYNYYFNSNYIRDIWGNPLQYNKKYYLQTQDKPGKGLIREYWSSFGYDYVILSDSKTITFPNNIRYGALYNGSKVLIKNSKKLDGLVRNKDFIQLEIDGYNMGISADRFNEDTNYIGTTYGTTHDLTTDFEIIQRQEKYRNYCQLKTPYNIFHKSGLMSTETSKPTFHDYRDWVYSSAWYFQNYENLNLRKHTKTNWYFIPKDEGWDED

SEQ ID NO: 127 - protein, 1296 aa, Clostridium botulinum
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKNIINTSILNLRYESNHLIDLSRYASKINIGSKVNFDPIDKNQIQLFNLESSKIEVILKNAIVYNSMYENFSTSFWIRIPKYFNSISLNNEYTIINCMENNSGWKVSLNYGEIIWTLQDTQEIKQRVVFKYSQMINISDYINRWIFVTITNNRLNNSKIYINGRLIDQKPISNLGNIHASNNIMFKLDGCRDTHRYIWIKYFNLFDKELNEKEIKDLYDNQSNSGILKDFWGDYLQYDKPYYMLNLYDPNKYVDVNNVGIRGYMYLKGPRGSVMTTNIYLNSSLYRGTKFIIKKYASGNKDNIVRNNDRVYINVVVKNKEYRLATNASQAGVEKILSALEIPDVGNLSQVVVMKSKNDQGITNKCKMNLQDNNGNDIGFIGFHQFNNIAKLVASNWYNRQIERSSRTLGCSWEFIPVDDGWGERPL

SEQ ID NO: 128 - protein, 1296 aa, Clostridium botulinum
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHDVLNLTRNGYGSTQYIRFSPDFTFGFEESLEVDTNPLLGAGKFATDPAVTLAHELIHAEHRLYGIAINPNRVFKVNTNAYYEMSGLEVSFEELRTFGGHDAKFIDSLQENEFRLYYYNKFKDVASTLNKAKSIIGTTASLQYMKNVFKEKYLLSEDTSGKFSVDKLKFDKLYKMLTEIYTEDNFVNFFKVINRKTYLNFDKAVFRINIVPDENYTIKDGFNLKGANLSTNFNGQNTEINSRNFTRLKNFTGLFEFYKLLCVRGIIPFKTKSLDEGYNKALNDLCIKVNNWDLFFSPSEDNFTNDLDKVEEITADTNIEAAEENISLDLIQQYYLTFDFDNEPENISIENLSSDIIGQLEPMPNIERFPNGKKYELDKYTMFHYLRAQEFEHGDSRIILTNSAEEALLKPNVAYTFFSSKYVKKINKAVEAFMFLNWAEELVYDFTDETNEVTTMDKIADITIIVPYIGPALNIGNMLSKGEFVEAIIFTGVVAMLEFIPEYALPVFGTFAIVSYIANKVLTVQTINNALSKRNEKWDEVYKYTVTNWLAKVNTQIDLIREKMKKALENQAEATKAIINYQYNQYTEEEKNNINFNIDDLSSKLNESINSAMININKFLDQCSVSYLMNSMIPYAVKRLKDFDASVRDVLLKYIYDNRGTLVLQVDRLKDEVNNTLSADIPFQLSKYVDNKKLLSTFTEYIKNIVNTSILSIVYKKDDLIDLSRYGAKINIGDRVYYDSIDKNQIKLINLESSTIEVILKNAIVYNSMYENFSTSFWIKIPKYFSKINLNNEYTIINCIENNSGWKVSLNYGEIIWTLQDNKQNIQRVVFKYSQMVNISDYINRWIFVTITNNRLTKSKIYINGRLIDQKPISNLGNIHASNKIMFKLDGCRDPRRYIMIKYFNLFDKELNEKEIKDLYDSQSNSGILKDFWGNYLQYDKPYYMLNLFDPNKYVDVNNIGIRGYMYLKGPRGSVVTTNIYLNSTLYEGTKFIIKKYASGNEDNIVRNNDRVYINVVVKNKEYRLATNASQAGVEKILSALEIPDVGNLSQVVVMKSKDDQGIRNKCKMNLQDNNGNDIGFIGFHLYDNIAKLVASNWYNRQVGKASRTFGCSWEFIPVDDGWGESSL

SEQ ID NO: 129 - protein, 1292 aa, Clostridium botulinum
MPFVNKPFNYRDPGNGVDIAYIKIPNAGQMQPVKAFKIHEGVWVIPERDTFTNPEEGDLNPPPEAKQVPVSYYDSTYLSTDNEKDNYLKGVIKLFDRIYSTGLGRMLLSFIVKGIPFWGGSTIDTELKVIDTNCINVIEPGGSYRSEELNLVITGPSADIIQFECKSFGHDVFNLTRNGYGSTQYIRFSPDFTFGFEESLEVDTNPLLGAGTFATDPAVTLAHELIHAAHRLYGIAINPNRVLKVKTNAYYEMSGLEVSFEELRTFGGNDTNFIDSLWQKKFSRDAYDNLQNIARILNEAKTIVGTTTPLQYMKNIFIRKYFLSEDASGKISVNKAAFKEFYRVLTRGFTELEFVNPFKVINRKTYLNFDKAVFRINIVPDENYTINEGFNLEGANSNGQNTEINSRNFTRLKNFTGLFEFYKLLCVRGIIPFKTKSLDEGYNKALNYLCIKVNNWDLFFSPSEDNFTNDLDKVEEITADTNIEAAEENISSDLIQQYYLTFDFDNEPENISIENLSSDIIGQLEPMPNIERFPNGKKYELDKYTMFHYLRAQEFEHGDSRIILTNSAEEALLKPNVAYTFFSSKYVKKINKAVEAVIFLSWAEELVYDFTDETNEVTTMDKIADITIIVPYIGPALNIGNMVSKGEFVEAILFTGVVALLEFIPEYSLPVFGTFAIVSYIANKVLTVQTINNALSKRNEKWDEVYKYTVTNWLAKVNTQIDLIREKMKKALENQAEATRAIINYQYNQYTEEEKNNINFNIDDLSSKLNRSINRAMININKFLDQCSVSYLMNSMIPYAVKRLKDFDASVRDVLLKYIYDNRGTLILQVDRLKDEVNNTLSADIPFQLSKYVNDKKLLSTFTEYIKNIVNTSILSIVYKKDDLIDLSRYGAKINIGDRVYYDSIDKNQIKLINLESSTIEVILKNAIVYNSMYENFSTSFWIKIPKYFSKINLNNEYTIINCIENNSGWKVSLNYGEIIWTLQDNKQNIQRVVFKYSQMVNISDYINRWMFVTITNNRLTKSKIYINGRLIDQKPISNLGNIHASNKIMFKLDGCRDPRRYIMIKYFNLFDKELNEKEIKDLYDSQSNPGILKDFWGNYLQYDKPYYMLNLFDPNKYVDVNNIGIRGYMYLKGPRGSVMTTNIYLNSTLYMGTKFIIKKYASGNEDNIVRNNDRVYINVVVKNKEYRLATNASQAGVEKILSALEIPDVGNLSQVVVMKSKDDQGIRNKCKMNLQDNNGNDIGFVGFHLYDNIAKLVASNWYNRQVGKASRTFGCSWEFIPVDDGWGESSL

SEQ ID NO: 130 - protein, 1296 aa, Clostridium botulinum
MPLVNQQINYYDPVNGVDIAYIKIPNAGKMQPVKAFKIHNKVWVIPERDIFTNPEEVDLNPPPEAKQVPISYYDSAYLSTDNEKDNYLKGVIKLFERIYSTDLGRMLLISIVRGIPFWGGGKIDTELKVIDTNCINIIQLDDSYRSEELNLAIIGPSANIIESQCSSFRDDVLNLTRNGYGSTQYIRFSPDFTVGFEESLEVDTNPLLGAGKFAQDPAVALAHELIHAEHRLYGIAINTNRVFKVNTNAYYEMAGLEVSLEELITFGGNDAKFIDSLQKKEFSLYYYNKFKDIASTLNKAKSIVGTTASLQYMKNVFKEKYLLSEDATGKFLVDRLKFDELYKLLTEIYTEDNFVKFFKVLNRKTYLNFDKAVFKINIVPDVNYTIHDGFNLRNTNLAANFNGQNIEINNKNFDKLKNFTGLFEFYKLLCVRGIITSKTKSLDEGYNKALNELCIKVNNWDLFFSPSEDNFTNDLDKVEEITSDTNIEAAEENISLDLIQQYYLNFNFDNEPENTSIENLSSDIIGQLEPMPNIERFPNGKKYELNKYTMFHYLRAQEFKHSNSRIILTNSAKEALLKPNIVYTFFSSKYIKAINKAVEAVTFVNWIENLVYDFTDETNEVSTMDKIADITIVIPYIGPALNIGNMIYKGEFVEAIIFSGAVILLEIVPEIALPVLGTFALVSYVSNKVLTVQTIDNALSKRNEKWDEVYKYIVTNWLAIVNTQINLIREKMKKALENQAEATKAIINYQYNQYTEEEKNNINFNIDDLSSKLNESINSAMININKFLDQCSVSYLMNSMIPYAVKRLKDFDASVRDVLLKYIYDNRGTLIGQVNRLKDKVNNTLSADIPFQLSKYVDNKKLLSTFTEYIKNITNASILSIVYKDDDLIDLSRYGAEIYNGDKVYYNSIDKNQIRLINLESSTIEVILKKAIVYNSMYENFSTSFWIRIPKYFNSISLNNEYTIINCMENNSGWKVSLNYGEIIWTFQDTQEIKQRVVFKYSQMINISDYINRWIFVTITNNRITKSKIYINGRLIDQKPISNLGNIHASNKIMFKLDGCRDPHRYIVIKYFNLFDKELSEKEIKDLYDNQSNSGILKDFWGDYLQYDKSYYMLNLYDPNKYVDVNNVGIRGYMYLKGPRDNVMTTNIYLNSSLYMGTKFIIKKYASGNKDNIVRNNDRVYINVVVKNKEYRLATNASQAGVEKILSALEIPDVGNLSQVVVMKSKNDQGITNKCKMNLQDNNGNDIGFIGFHQFNNIAKLVASNWYNRQIERSSRTLGCSWEFIPVDDGWRERPL

SEQ ID NO: 131 - protein, 1296 aa, Clostridium botulinum
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTELGRMLLTSIVRGIPFWGGSTIDTELKVIDTNCINVIQPDGSYRSEELNLVIIGPSADIIQFECKSFGHDVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGEHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPEVNYTIYDGFNLRNTNLAANFNGQNTEINNMNFTKLKNFTGLFEFYKLLCVRGIITSKTKSLDEGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIVLTNSVNEALLNPSSVYTFFSSDYVRKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWGEVYKYIVTNWLAKVNTQIDLIRKKMKEALENQAEATKAIINYQYNQYTEEEKNNINFNIGDLSSKLNDSINKAMININKFLNQCSVSYLMNSMIPYGVKRLEDFDASLKDALLKYIYDNRGTLIGQVDRLKDKVNNTLSTDIPFQLSKYVDNQRLLSTFTEYIKNIINTSILNLRYESNHLIDLSRYASEINIGSKVNFDPIDKNQIQLFNLESSKIEIILKNAIVYNSMYENFSTSFWIKIPKYFSKINLNNEYTIINCIENNSGWKVSLNYGEIIWTLQDNKQNIQRVVFKYSQMVAISDYINRWIFITITNNRLNNSKIYINGRLIDQKPISNLGNIHASNNIMFKLDGCRDPQRYIWIKYFNLFDKELNEKEIKDLYDNQSNSGILKDFWGNYLQYDKPYYMLNLYDPNKYVDVNNVGIRGYMYLKGPRGSIVTTNIYLNSSLYMGTKFIIKKYASGNKDNIVRNNDRVYINVVVKNKEYRLATNASQAGVEKILSVLEIPDVGNLSQVVVMKSKNDQGIRNKCKMNLQDNNGNDIGFIGFHQFNNIDKLVASNWYNRQIERSSRTFGCSWEFIPVDDGWGESPL

SEQ ID NO: 132 - protein, 1296 aa, Clostridium botulinum
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFAKLKNFTGLFEFYKLLCVRGIITSKTKSLDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLSAQEFEHGKSRIDLTNSVNEALLNPSHVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFAIVSYIANKVLTVQTINNALSKRNEKWDEVYKYTVTNWLAKVNTQIDLIREKMKKALENQAEATKAIINYQYNQYTEEEKNNINFNIDDLSSKLNESINSAMININKFLDQCSVSYLMNSMIPYAVKRLKDFDASVRDVLLKYIYDNRGTLIGQVDRLKDKVNNTLSTDIPFQLSKYVDNQRLLSTFTEYIKNIINTSILSLRYENNHLIDLSRYASKINIGSRVNFDPIDKNQIQLFNLESSKIEVILKNAIVYNSMYENFSTSFWIKIPKYFSEISLNNEYTIINCIENNSGWKVSLNYGEIIWTLQDNKQNIQRVVFKYSQMVAISDYINRWIFITITNNRLTKSKIYINGRLIDQKPISNLGNIHASNKIMFKLDGCRDPRRYIMIKYFNLFDKELNEKEIKDLYDSQSNSGILKDFWGNYLQYDKPYYMLNLFDPNKYVDVNNVGIRGYMYLKGSRSTLLTTNIYLNSGLYMGTKFIIKKYASGNKDNIVRNNDRVYINVVVNNKEYRLATNASQAGVEKILSALEIPDIGNLSQVVVMKSKNDQGIRNKCKMNLQDNNGNDIGFIGFHKFNDIYKLVASNWYNRQIEISSRTFGCSWEFIPVDDGWGEKPL

SEQ ID NO: 133 - protein, 1296 aa, Clostridium botulinum
MPFVNKQFNYKDPVNGVDIAYIKIPNAGQMQPVKAFKIHNKIWVIPERDIFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIINFECKSFGHDVLNLTRNGYGSTQYIRFSPDFTFGFEESLEVDTNPLLGAGKFAIDPAVTLAHELIHAGHRLYGIAINPNRVFKVNTNAYYEMSGLEVSFEELRTFGGHDAKFIDSLQENEFRLYYYNKFKEVASILNKAKSIIGTTASLQYMKNVFKEKYLLSEDTSGKFSVDKLRFDKLYKMLTEIYTEDNFVKFFKVLNRKTYLNFDKAVFKMNIVPEVNYTIYDGFNLRNTNLAANFNGQNTEINNMNFTKLKNFTGLFEFYKLLCVRGIITSKTKSLDEGYNKALNDLCIKVNNWDLFFSPSEDNFTNDLNKGEEITSDTNIEAAEENISSDLIQQYYLTFNFDNEPENISIENLSSDIIGQLELMPNIERFPNGKKYELDKYTMFHYLRAQEFEYGNSRIVLINSVNEALLNPSSVYTFFSSDYVKKANEATEAAMFLGWVEQLVYDFTDETSEVSTMDKIADITIIVPYIGPALNIGNMVYKKKFEEALIFSGAVILLEFVPEIVLPILGTFALVSYTSNKVLTVRTIDNALSKRNEKWEEVYKYIVTNWLAKVNTQINLIRKKMKEALENQAEATKAIINYQYNQYTEEEKNNINFNIGDLSSKLNDSINKAMININKFLDQCSVSYLMNSMIPQGVKQLKDFDTSLRDSLLKYIYDNRGTLIGQVDRLKDKVNNTLSTDIPFQLSKYADNQRLLSTFTEYIKNIINTSILNLRYESNHLIDLSRYASKINIGSRVNFDPIDKNQIQLFNLESSKIEVILKNAIVYNSMYENFSTSFWIKIPKYFSKINLNNEYTIINCIENNSGWKVSLNYGEIIWTLQDNEQNIQRVVFKYSQMVNISDYINRWIFVTITNNRLTKSKIYINGRLIDQKPISNLGNIHASNKIMFKLDGCRDPHRYILIKYFNLFDKELNEKEIKDLYDNQSNSGILKDFWGDYLQYDKPYYMLNLYDPNKYIDVNNIGIRGYMYLKGPRGSVTTTNIYLNSMLYMGTKFIIKKHASGNKDNIVRNNDRVYINVLVKNKEYRLATNASQAGGEKILSAVEIPDVGNLSQVVVMKSKNDQGIRNKCKMNLQDNNGNDIGFIGFHQFNNIAKLVASNWYNRQIGKTSVTLGCSWELIPVDYGWGESSL

SEQ ID NO: 134 - protein, 1297 aa, Clostridium botulinum
MPFVNKQFNYKDTVNGIDIAYIKIPNAGQMQPVKAFKIHNKIWVIPERDTFTNPKEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHDVLNLTRNGYGSTQYIRFSPDFTFGFEESLEVDTNPLLGAGKFATDPAVTLAHELIHAEHRLYGIAINPNRVFKVNTNAYYEMSGLEVSFEELRTFGGHNAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPDENYTIKDGFNLKNTNLAANFNGQNTEINSRNFTKLKNFTGLFEFYKLLCVRGIIPFKTKSLDEGYNKALNDLCIKVNNWDLFFSPSEDNFTNDLDKVEEITSDTNIEAAEENISLDLIQQYYLTFDFDNEPENISIENLSSDIIGQLEPMPNIERFPNGKKYELDKYTMFHYLRAQEFEHSKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLVRKKMKEALENQAEATKAIINYQYNQYTEEEKNNINFNIDDLSSKLNESINSAMTNINKFLDQCSVSYLMNSMIPYAVKRLKDFDASVREVLLKYIYDNRGTLILQVDRLKDKVNNTLSADIPFQLSKYVDNKKLLSTFTEYIKNITNTSILSIVVDKDGRLIDLSRYGAEIYNGDKVSYNSIDKNQIKLINLESSAIEVILKNAIVYNSMYENFSTSFWIKIPKYFSKINLNNEYTIINCIENNSGWKVSLNYGEIIWTLQDNQQNIQRVVFKYSQMVNISDYINRWIFVTITNNRLDKSKIYINGRLIDQKPISNLGNIHASNNIMFKLDGCRDPRRYIVIKYFNLFDKELNEKEIKDLYDNQSNSGILKDFWGDYLQYDKPYYMLNLYDPNKYVDVNNIGIRGYMYLKGPRGSVVTTNIYLNSTLYMGTKFIIKKYASGNKDNIVRNNDRVYINVVVKNKEYRLATNALQAGVEKILSALEIPDVGNLSQVVVMKSKNDQGIRNKCKMNLQDNNGNDIGLIGFHQFNNIAKLVASNWYNRQVGKASRTFGCSWEFIPVDDGWGESSQ

SEQ ID NO: 135 - protein, 1291 aa, Clostridium botulinum C phage
MPITINNFNYSDPVDNKNILYLDTHLNTLANEPEKAFRITGNIWVIPDRFSRNSNPNLNKPPRVTSPKSGYYDPNYLSTDSDKDPFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCHKAIDGRSLYNKTLDCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFNNINDSKILSLQNRKNTLVDTSGYNAEVSEEGDVQLNPIFPFDFKLGSSGEDRGKVIVTQNENIVYNSMYESFSISFWIRINKWVSNLPGYTIIDSVKNNSGWSIGIISNFLVFTLKQNEDSEQSINFSYDISNNAPGYNKWFFVTVTNNMMGNMKIYINGKLIDTIKVKELTGINFSKTITFEINKIPDTGLITSDSDNINMWIRDFYIFAKELDGKDINILFNSLQYTNVVKDYWGNDLRYNKEYYMVNIDYLNRYMYANSRQIVFNTRRNNNDFNEGYKIIIKRIRGNTNDTRVRGGDILYFDMTINNKAYNLFMKNETMYADNHSTEDIYAIGLREQTKDINDNIIFQIQPMNNTYYYASQIFKSNFNGENISGICSIGTYRFRLGGDWYRHNYLVPTVKQGNYASLLESTSTHWGFVPVSE

SEQ ID NO: 136 - protein, 1252 aa, Clostridium butyricum
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQDILLPNVIIMGAEPDLFETNSSNISLRNNYMPSNHGFGSIAIVTFSPEYSFRFNDNSMNEFIQDPALTLMHELIHSLHGLYGAKGITTKYTITQKQNPLITNIRGTNIEEFLTFGGTDLNIITSAQSNDIYTNLLADYKKIASKLSKVQVSNPLLNPYKDVFEAKYGLDKDASGIYSVNINKFNDIFKKLYSFTEFDLATKFQVKCRQTYIGQYKYFKLSNLLNDSIYNISEGYNINNLKVNFRGQNANLNPRIITPITGRGLVKKIIRFCKNIVSVKGIRKSICIEINNGELFFVASENSYNDDNINTPKEIDDTVTSNNNYENDLDQVILNFNSESAPGLSDEKLNLTIQNDAYIPKYDSNGTSDIEQHDVNELNVFFYLDAQKVPEGENNVNLTSSIDTALLEQPKIYTFFSSEFINNVNKPVQAALFVSWIQQVLVDFTTEANQKSTVDKIADISIVVPYIGLALNIGNEAQKGNFKDALELLGAGILLEFEPELLIPTILVFTIKSFLGSSDNKNKVIKAINNALKERDEKWKEVYSFIVSNWMTKINTQFNKRKEQMYQALQNQVNAIKTIIESKYNSYTLEEKNELTNKYDIKQIENELNQKVSIAMNNIDRFLTESSISYLMKLINEVKINKLREYDENVKTYLLNYIIQHGSILGESQQELNSMVTDTLNNSIPFKLSSYTDDKILISYFNKFFKRIKSSSVLNMRYKNDKYVDTSGYDSNININGDVYKYPTNKNQFGIYNDKLSEVNISQNDYIIYDNKYKNFSISFWVRIPNYDNKIVNVNNEYTIINCMRDNNSGWKVSLNHNEIIWTLQDNAGINQKLAFNYGNANGISDYINKWIFVTITNDRLGDSKLYINGNLIDQKSILNLGNIHVSDNILFKIVNCSYTRYIGIRYFNIFDKELDETEIQTLYSNEPNTNILKDFWGNYLLYDKEYYLLNVLKPNNFIDRRKDSTLSINNIRSTILLANRLYSGIKVKIQRVNNSSTNDNLVRKNDQVYINFVASKTHLFPLYADTATTNKEKTIKISSSGNRFNQVVVMNSVGNNCTMNFKNNNGNNIGLLGFKADTVVASTWYYTHMRDHTNSNGCFWNFISEEHGWQEK

SEQ ID NO: 137 - protein, 1278 aa, Clostridium botulinum
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENSSYPVRKLMDSGGVYDPSNDGFGSINIVTFSPEYEYTFNDISGGYNSSTESFIADPAISLAHELIHALHGLYGARGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKFKVKCRNTYFIKYGFLKVPNLLDDDIYTVSEGFNIGNLAVNNRGQNIKLNPKIIDSIPDKGLVEKIVKFCKSVIPRKGTKAPPRLCIRVNNRELFFVASESSYNENDINTPKEIDDTTNLNNNYRNNLDEVILDYNSETIPQISNQTLNTLVQDDSYVPRYDSNGTSEIEEHNVVDLNVFFYLHAQKVPEGETNISLTSSIDTALSEESQVYTFFSSEFINTINKPVHAALFISWINQVIRDFTTEATQKSTFDKIADISLVVPYVGLALNIGNEVQKENFKEAFELLGAGILLEFVPELLIPTILVFTIKSFIGSSENKNKIIKAINNSLMERETKWKEIYSWIVSNWLTRINTQFNKRKEQMYQALQNQVDAIKTVIEYKYNNYTSDERNRLESEYNINNIREELNKKVSLAMENIERFITESSIFYLMKLINEAKVSKLREYDEGVKEYLLDYISEHRSILGNSVQELNDLVTSTLNNSIPFELSSYTNDKILILYFNKLYKKIKDNSILDMRYENNKFIDISGYGSNISINGDVYIYSTNRNQFGIYSSKPSEVNIAQNNDIIYNGRYQNFSISFWVRIPKYFNKVNLNNEYTIIDCIRNNNSGWKISLNYNKIIWTLQDTAGNNQKLVFNYTQMISISDYINKWIFVTITNNRLGNSRIYINGNLIDEKSISNLGDIHVSDNILFKIVGCNDTRYVGIRYFKVFDTELGKTEIETLYSDEPDPSILKDFWGNYLLYNKRYYLLNLLRTDKSITQNSNFLNINQQRGVYQKPNIFSNTRLYTGVEVIIRKNGSTDISNTDNFVRKNDLAYINVVDRDVEYRLYADISIAKPEKIIKLIRTSNSNNSLGQIIVMDSIGNNCTMNFQNNNGGNIGLLGFHSNNLVASSWYYNNIRKNTSSNGCFWSFISKEHGWQEN

SEQ ID NO: 138 - protein, 1297 aa, Artificial Sequence
  Synthetic polypeptide
  misc_feature (7)..(7): Xaa can be any naturally occurring amino acid
MPVNIKXFNYNDPINNDDIIMMEPFNDPGPGTYYKAFRIIDRIWIVPERFTYGFQPDQFNASTGVFSKDVYEYYDPTYLKTDAEKDKFLKTMIKLFNRINSKPSGQRLLDMIVDAIPYLGNASTPPDKFAANVANVSINKKIIQPGAEDQIKGLMTNLIIFGPGPVLSDNFTDSMIMNGHSPISEGFGARMMIRFCPSCLNVFNNVQENKDTSIFSRRAYFADPALTLMHELIHVLHGLYGIKISNLPITPNTKEFFMQHSDPVQAEELYTFGGHDPSVISPSTDMNIYNKALQNFQDIANRLNIVSSAQGSGIDISLYKQIYKNKYDFVEDPNGKYSVDKDKFDKLYKALMFGFTETNLAGEYGIKTRYSYFSEYLPPIKTEKLLDNTIYTQNEGFNIASKNLKTEFNGQNKAVNKEAYEEISLEHLVIYRIAMCKPVMYKNTGKSEQCIIVNNEDLFFIANKDSFSKDLAKAETIAYNTQNNTIENNFSIDQLILDNDLSSGIDLPNENTEPFTNFDDIDIPVYIKQSALKKIFVDGDSLFEYLHAQTFPSNIENLQLTNSLNDALRNNNKVYTFFSTNLVEKANTVVGASLFVNWVKGVIDDFTSESTQKSTIDKVSDVSIIIPYIGPALNVGNETAKENFKNAFEIGGAAILMEFIPELIVPIVGFFTLESYVGNKGHIIMTISNALKKRDQKWTDMYGLIVSQWLSTVNTQFYTIKERMYNALNNQSQAIEKIIEDQYNRYSEEDKMNINIDFNDIDFKLNQSINLAINNIDDFINQCSISYLMNRMIPLAVKKLKDFDDNLKRDLLEYIDTNELYLLDEVNILKSKVNRHLKDSIPFDLSLYTKDTILIQVFNNYISNISSNAILSLSYRGGRLIDSSGYGATMNVGSDVIFNDIGNGQFKLNNSENSNITAHQSKFVVYDSMFDNFSINFWVRTPKYNNNDIQTYLQNEYTIISCIKNDSGWKVSIKGNRIIWTLIDVNAKSKSIFFEYSIKDNISDYINKWFSITITNDRLGNANIYINGSLKKSEKILNLDRINSSNDIDFKLINCTDTTKFVWIKDFNIFGRELNATEVSSLYWIQSSTNTLKDFWGNPLRYDTQYYLFNQGMQNIYIKYFSKASMGETAPRTNFNNAAINYQNLYLGLRFIIKKASNSRNINNDNIVREGDYIYLNIDNISDESYRVYVLVNSKEIQTQLFLAPINDDPTFYDVLQIKKYYEKTTYNCQILCEKDTKTFGLFGIGKFVKDYGYVWDTYDNYFCISQWYLRRISENINKLRLGCNWQFIPVDEGWTE

SEQ ID NO: 139 - protein, 1288 aa, Clostridium botulinum
MPVVINSFNYDDPVNDNTIIYIRPPYYETSNTYFKAFQIMDNVWIIPERYRLGIDPSLFNPPVSLKAGSDGYFDPNYLSTNTEKNKYLQIMIKLFKRINSKPAGQILLEEIKNAIPYLGNSYTQEEQFTTNNRTVSFNVKLANGNIVQQMANLIIWGPGPDLTTNKTGGIIYSPYQSMEATPYKDGFGSIMTVEFSPEYATAFNDISIASHSPSLFIKDPALILMHELIHVLHGLYGTYITEYKITPNVVQSYMKVTKPITSAEFLTFGGRDRNIVPQSIQSQLYNKVLSDYKRIASRLNKVNTATALINIDEFKNLYEWKYQFAKDSNGVYSVDLNKFEQLYKKIYSFTEFNLAYEFKIKTRLGYLAENFGPFYLPNLLDDSIYTEVDGFNIGALSINYQGQNIGSDINSIKKLQGQGVVSRVVRLCSNSNTKNSLCITVNNRDLFFIASQESYGENTINTYKEIDDTTTLDPSFEDILDKVILNFNEQVIPQMPNRNVSTDIQKDNYIPKYDYNRTDIIDSYEVGRNYNTFFYLNAQKFSPNESNITLTSSFDTGLLEGSKVYTFFSSDFINNINKPVQALLFIEWVKQVIRDFTTEATKTSTVDKLKDISLVVPYIGLALNIGDEIYKQHFAEAVELVGAGLLLEFSPEFLIPTLLIFTIKGYLTGSIRDKDKIIKTLDNALNVRDQKWKELYRWVVSKWLTTINTQFNKRKEQMYKALKNQATAIKKIIENKYNNYTTDEKSKIDSSYNINEIERTLNEKINLAMKNIEQFITESSIAYLINIINNETIQKLKSYDDLVRRYLLGYIRNHSSILGNSVEELNSKVNNHLDNGIPFELSSYTNDSLLIRYFNKNYGELKYNCILNIKYEMDRDKLVDSSGYRSRINIGTGVKFSEIDKNQVQLSNLESSKIEVILNNGVIYNSMYENFSTSFWIRIPKYFRNINNEYKIISCMQNNSGWEVSLNFSNMNSKIIWTLQDTEGIKKTVVFQYTQNINISDYINRWIFVTITNNRLSNSKIYINGRLINEESISDLGNIHASNNIMFKLDGCRDPHRYIWIKYFNLFDKELNKKEIKDLYDNQSNSGILKDFWGDYLQYDKPYYMLNLYDPNKYLDVNNVGIRGYMYLKGPRGRIVTTNIYLNSTLYMGTKFIIKKYASGNKDNIVRNNDRVYINVVVKNKEYRLATNASQAGVEKILSAVEIPDVGNLSQVVVMKSENDQGIRNKCKMNLQDNNGNDIGFIGFHQFNNIAKLVASNWYNRQIGKASRTFGCSWEFIPVDDGWGESSL

SEQ ID NO: 140 - protein, 1276 aa, Clostridium botulinum D phage
MTWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCLRLTKNSRDDSTCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFNSINDSKILSLQNKKNALVDTSGYNAEVRVGDNVQLNTIYTNDFKLSSSGDKIIVNLNNNILYSAIYENSSVSFWIKISKDLTNSHNEYTIINSIEQNSGWKLCIRNGNIEWILQDVNRKYKSLIFDYSESLSHTGYTNKWFFVTITNNIMGYMKLYINGELKQSQKIEDLDEVKLDKTIVFGIDENIDENQMLWIRDFNIFSKELSNEDINIVYEGQILRNVIKDYWGNPLKFDTEYYIINDNYIDRYIAPESNVLVLVQYPDRSKLYTGNPITIKSVSDKNPYSRILNGDNIILHMLYNSRKYMIIRDTDTIYATQGGECSQNCVYALKLQSNLGNYGIGIFSIKNIVSKNKYCSQIFSSFRENTMLLADIYKPWRFSFKNAYTPVAVTNYETKLLSTSSFWKFISRDPGWVE

What is claimed is:

1. A method of recombinantly producing a Botulinum neurotoxin (BoNT) comprising:

culturing a *Bacillus subtilis* cell comprising a nucleotide sequence that encodes the BoNT, wherein the BoNT comprises the amino acid sequence of SEQ ID NO: 127; and purifying the BoNT from the *Bacillus subtilis* cell.

2. The method of claim 1, wherein the nucleotide sequence that encodes the BoNT is operably linked to a promoter.

3. The method of claim 2, wherein the promoter is an inducible promoter.

4. The method of claim 1, wherein the nucleotide sequence that encodes the BoNT is in an expression vector.

5. The method of claim 1, wherein the BoNT is fused to a fusion domain at the N- or C-terminus.

6. The method of claim 5, wherein the fusion domain is an affinity tag.

7. The method of claim 1, wherein the nucleotide sequence that encodes the BoNT is codon optimized for expression in the *Bacillus subtilis* cell.

8. The method of claim 1, further comprising delivering the nucleotide sequence that encodes the BoNT into the *Bacillus subtilis* cell.

9. The method of claim 1, wherein the *Bacillus subtilis* cell is an engineered cell.

10. The method of claim 1, wherein the *Bacillus subtilis* cell is a protease deficient *Bacillus subtilis* cell.

11. The method of claim 1, wherein the BoNT is expressed at a yield of 5-10 mg per liter of *Bacillus subtilis* cell cultured.

12. A method for recombinantly producing a Botulinum neurotoxin type A (BoNT/A) comprising:

culturing a *Bacillus subtilis* cell comprising an expression vector that encodes the BoNT/A fused to an affinity tag, wherein the BoNT/A comprises the amino acid of SEQ ID NO: 127; and purifying the BoNT/A from the *Bacillus subtilis* cell using the affinity tag.

* * * * *